United States Patent
Heiland

(10) Patent No.: US 12,398,195 B2
(45) Date of Patent: *Aug. 26, 2025

(54) LAMP CONSTRUCTS COMPRISING ALLERGENS

(71) Applicant: Immunomic Therapeutics, Inc, Rockville, MD (US)

(72) Inventor: Teri Heiland, New Market, MD (US)

(73) Assignee: Immunomic Therapeutics, Inc., Rockville, MD (US)

( * ) Notice: Subject to any disclaimer, the term of this patent is extended or adjusted under 35 U.S.C. 154(b) by 883 days.

This patent is subject to a terminal disclaimer.

(21) Appl. No.: 17/053,784

(22) PCT Filed: May 14, 2019

(86) PCT No.: PCT/US2019/032305
§ 371 (c)(1),
(2) Date: Nov. 8, 2020

(87) PCT Pub. No.: WO2019/222281
PCT Pub. Date: Nov. 21, 2019

(65) Prior Publication Data
US 2021/0261647 A1 Aug. 26, 2021

Related U.S. Application Data

(60) Provisional application No. 62/673,932, filed on May 20, 2018, provisional application No. 62/672,378, filed on May 16, 2018, provisional application No. 62/672,005, filed on May 15, 2018.

(51) Int. Cl.
| | |
|---|---|
| *C07K 14/705* | (2006.01) |
| *A61K 39/00* | (2006.01) |
| *A61K 39/35* | (2006.01) |
| *A61K 39/36* | (2006.01) |
| *A61P 37/08* | (2006.01) |
| *C07K 14/415* | (2006.01) |
| *C07K 14/435* | (2006.01) |
| *C07K 14/47* | (2006.01) |

(52) U.S. Cl.
CPC ........ *C07K 14/70596* (2013.01); *A61K 39/35* (2013.01); *A61K 39/36* (2013.01); *A61P 37/08* (2018.01); *C07K 14/415* (2013.01); *C07K 14/43509* (2013.01); *C07K 14/43531* (2013.01); *C07K 14/43568* (2013.01); *C07K 14/43572* (2013.01); *C07K 14/4359* (2013.01); *C07K 14/47* (2013.01); *A61K 2039/545* (2013.01); *C07K 2319/00* (2013.01)

(58) Field of Classification Search
None
See application file for complete search history.

(56) References Cited

U.S. PATENT DOCUMENTS

| | | | | |
|---|---|---|---|---|
| 11,203,629 | B2* | 12/2021 | Heiland | ................. A61P 35/00 |
| 11,773,153 | B2* | 10/2023 | Heiland | ........... C07K 14/70596 |
| 2007/0269457 | A1 | 11/2007 | Niazi et al. | |
| 2012/0294879 | A1 | 11/2012 | August et al. | |
| 2016/0185831 | A1 | 6/2016 | Hearl et al. | |
| 2016/0271245 | A1 | 9/2016 | Hearl et al. | |

FOREIGN PATENT DOCUMENTS

| | | |
|---|---|---|
| JP | 2004537285 A | 12/2004 |
| JP | 2012500829 A | 1/2012 |
| JP | 2013503159 A | 1/2013 |
| JP | 2015521467 | 9/2015 |
| JP | 2019537447 A | 12/2019 |
| JP | 2020517271 A | 6/2020 |
| JP | 2020518613 A | 6/2020 |
| WO | 2002080851 A2 | 10/2002 |
| WO | 2010023247 A1 | 3/2010 |
| WO | 2011031298 A1 | 3/2011 |
| WO | 2011046996 A2 | 4/2011 |
| WO | 2013187906 A1 | 12/2013 |
| WO | 2015200357 A2 | 12/2015 |
| WO | 2017020026 A1 | 2/2017 |
| WO | 2018093932 A2 | 5/2018 |
| WO | 2018195527 A1 | 10/2018 |
| WO | 2018204534 A1 | 11/2018 |

OTHER PUBLICATIONS

Preliminary Report on Patentability dated Nov. 26, 2020 and received in PCT/US2019/032305.
Carlsson et al., "Assignment of O-Glycan Attachment Sites to the Hinge-like Regions of Human Lysosomal Membrane Glycoproteins Lamp-1 and Lamp-2," Archive of Biochemistry and Biophysics, 1993, 304(1): 65-73.
Godinho et al., "Regulation of HIV-Gag Expression and Targeting to the Endolysosomal/Secretory Pathway by the Luminal Domain of Lysosomal-Associated Membrane Protein (LAMP-1) Enhance Gag-Specific Immune Response," PLOS One, 2014, 9(6):e99887, 11 pages.

(Continued)

*Primary Examiner* — Nora M Rooney
(74) *Attorney, Agent, or Firm* — McNeill PLLC

(57) ABSTRACT

The present invention provides improved LAMP Constructs comprising specific fragments of the LAMP lumenal domain to deliver allergens to immune cells for enhanced processing. These LAMP Constructs can be used for the treatment of disease and in particular allergic reactions and/or allergies. The improved LAMP Constructs allow for presentation of properly configured three dimensional epitopes for production of an immune response when administered to a subject. The improved LAMP Constructs can be multivalent molecules, and/or can be provided as part of a multivalent vaccine containing two or more LAMP Constructs.

Figure 1:
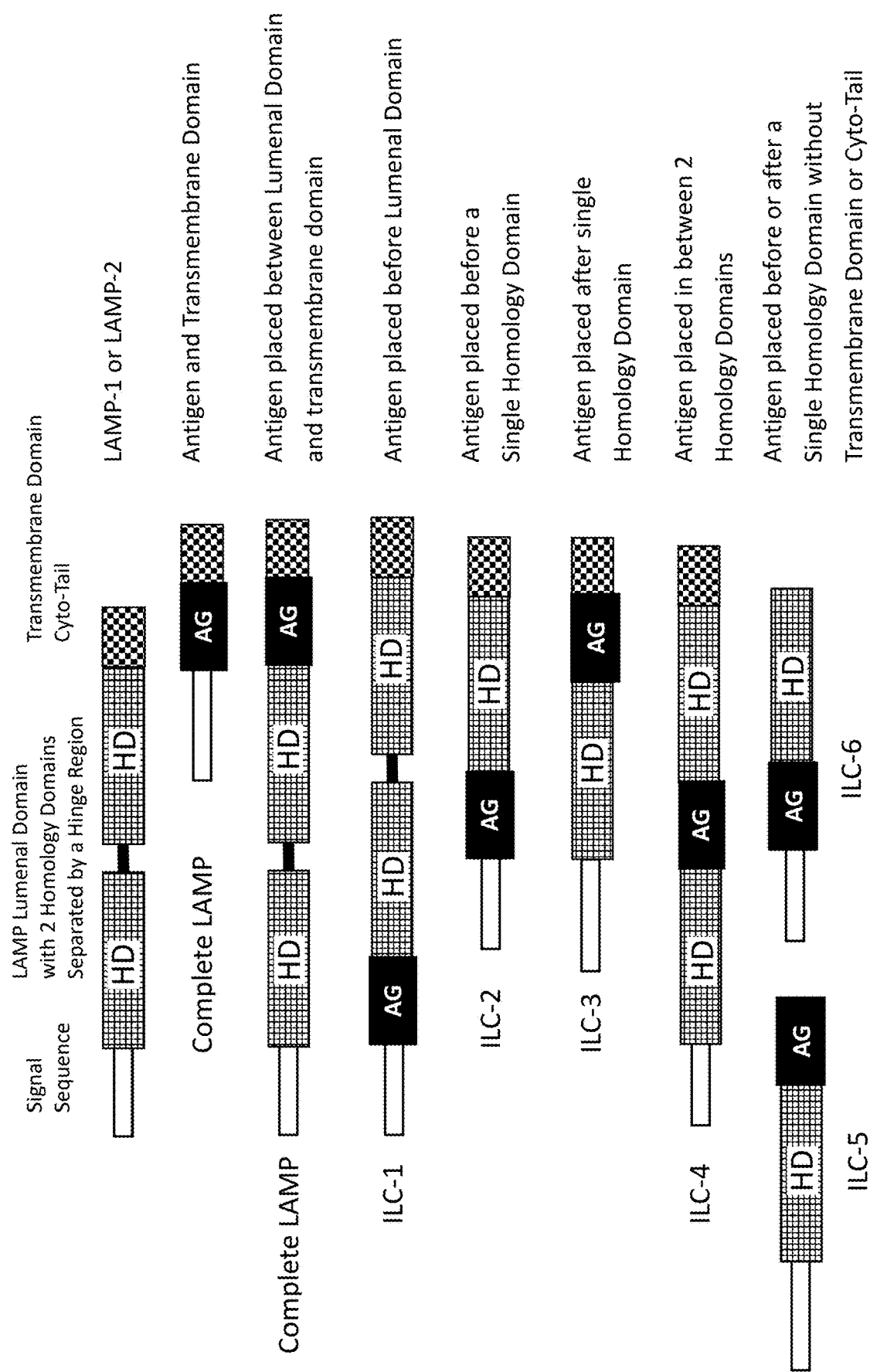

25 Claims, 60 Drawing Sheets
Specification includes a Sequence Listing.

(56) References Cited

OTHER PUBLICATIONS

Su et al., "CryJ-LAMP DNA Vaccines for Japanese Red Cedar Allergy Induce Robust Th1-Type Immune Responses in Murine Model," J Immunol Res, 2016, Article ID 4857869, 15 pages.
Wilke et al., "Crystal structure of the conserved domain of the DC lysosomal associated membrane protein: implications for the lysosomal glycocalyx," BMC Biology, 2012, 10:62, 15 pages.
International Search Report, Written Opinion and Search Strategy dated Sep. 2, 2019 and received in PCT/US2019/032305.
Tan, L. et al., "Intramuscular Immunization with DNA Construct Containing Der p 2 and Signal Peptide Sequences Primed Strong IgE Production", Vaccine, vol. 24, pp. 5762-5771, (2006).
Arruda et al., "Dendritic Cell-Lysosomal-Associated Membrane Protein (LAMP) and LAMP-1-HIV-1 Gag Chimeras Have Distinct Cellular Trafficking Pathways and Prime T and B Cell Responses to a Diverse Repertoire of Epitopes," J Immunology, 2006, 177: 2265-2275.
Arterburn et al., "The Disulfide Structure of Mouse Lysosome-associated Membrane Protein 1," J. Biol. Chem., 1990, 265:7419-7423.
Carlsson et al., "Structure of Human Lysosomal Membrane Glycoprotein 1, Assignment of Disulfide Bonds and Visualization of its Domain Arrangement," J. Biol. Chem, 1989, 264(34):20526-205311.
De Arruda et al. "DNA vaccine encoding human immunodeficiency virus-1 Gag, targeted to the major histocompatibility complex II compartment by lysosomal-associated membrane protein, elicits enhanced long-term memory response," Immunology, 2004, 112(1):126-33.

Godinho et al., "Regulation of HIV-Gag Expression and Targeting to the Endolysosomal /Secretory Pathway by the Luminal Domain of Lysosomal-Associated Membrane Protein (LAMP-1) Enhance Gag-Specific Immune Response," PLOS One, 2014, 9(6): e99887.
International Preliminary Report of Patentability mailed Oct. 31, 2019 and received in PCT/US2018/028753, 9 pages.
Nezafat et al., "Designing an efficient multi-epitope peptide vaccine against Vibrio cholerae via combined immunoinformatics and protein interaction based approaches," Comput Biol Chem, 2016, 62:82-95.
Official foreign office action issued for the corresponding EP Patent Application No. 18726576.4 on Nov. 16, 2020, 6 pages.
Wilke et al., "Crystal Structure of the conserved domain of the DC lysosomal associated membrane protein: implications for the lysosomal glycocalyx," BMC Biol., Oct. 2012:1-15.
Wimer-Mackin et al., "Transmembrane Domain Mutations Influence the Cellular Distribution of Lysosomal Membrane Glycoprotein A," Biochemical and Biophysical Research Comm., 1996, 229(2):472-478.
Written Opinion and International Search Report mailed Jun. 26, 2018 in PCT/US2018/028753, 16 pages.
Zhang et al., "Enhancement of Antitumor Immunity Using a DNA-Based Replicon Vaccine Derived from Semliki Forest Virus," PLOS One, 2014, 9(3): e90551.
Zhou et al., "Lamp-2a Facilitates MHC Class II Presentation of Cytoplasmic Antigens," Immunity, 2005, 22(5):571-581.

* cited by examiner

| Gene Name Accession No. | Alternative Names | SEQ ID NO. | Orthologs | Signal Seq. | Lumenal Domain ||||| Transmembrane Domain | Cytoplasmic Tail |
| --- | --- | --- | --- | --- | --- | --- | --- | --- | --- | --- | --- |
| | | | | | First Homologous domain | Hinge Region | Second Homologous Domain ||||
| h. LAMP-1 NP_005552.3 | CD107a; LAMPA; LGP120 | 1 | SEQ ID NO: 6-24 | 1-28 | 29-194 | 195-227 | 228 to 381 or 382 ||| 382 or 383 to 405 | 406-417 |
| h. LAMP-2 NP_002285.1 | CD107b; LAMPB; LGP110 | 2 | SEQ ID NO:25-43 | 1-28 | 29-192 | 193-228 | 229-375 ||| 376-399 | 400-410 |
| h. LAMP-3 NP_055213.2 | CD208; DC LAMP; DC-LAMP; DCLAMP; TSC403 | 3 | SEQ ID NO:44-55 | 1-27 | 28-219 | 220-234 | 235-381 ||| 382-402 | 403-416 |
| LIMP-2 Q14108 | AMRF; EPM4; LGP85; CD36L2; HLGP85; LIMPII; SR-BII; SCARB2 | 4 | SEQ ID NO:56-66 | *5-27 Transmem. *Uncleavable | | | 28-433 |||| 434-459 | 460-478 |
| h. Endolyn NP_006007.2 | Sialomucin CD164 MUC-24 | 5 | SEQ ID NO:73-79 | 1-23 | | | 24-162 |||| 163-183 | 184-197 |
| Macrosailin NP_001242.2 | CD68 | 80 | SEQ ID NO: 81-92 | 1-21 | | | 22-319 |||| 320-344 | 345-354 |

FIG. 2A

| | | | | | | |
|---|---|---|---|---|---|---|
| LAMP5 NP 036393 | BD-LAMP | 93 | SEQ ID NO: 94-101 | 1-29 | 30-235 | 236-256 | 257-280 |
| h. LIMBIC NP_002329.2 | LSAMP IGLON3 | 67 | SEQ ID NO: 68-72 and 102-113 | 1-28 | 29-315 | 316-338 | No tail |

FIG. 2A (cont.)

HUMAN LAMP-1 ALIGNMENT WITH ORTHOLOGOUS SEQUENCES

```
              SIGNAL SEQUENCE        LAMP HOMOLOGY DOMAIN 1
                                          1
SEQIDNO:1   MAAPGSARRPLLLLLLLLLGLMH--CASAAMFMVKNGN-GTACIMANFSAAFSVNYDTKS 58
SEQIDNO:6   MAAPGAR-RPLL---LLLLAGLAH--GASALFEVK-NN-GTTCIMASFSASFLTTYETAN 52
SEQIDNO:7   ------MARAAG-VCWTLLMGCVFA-AHAVTFEVTDGN--STCIKGELNASFSISYNTTN 50
SEQIDNO:8   -MSWRQVKMPVYWMAVMLLIGVVQ-VATAVQFEVKDGKTNITCILADLSINFSVSYNVSS 58
SEQIDNO:9   MAAPGSARRPLLLLLLLLLGLVH--CASAAMFMVKNGN-GTACIMANFSASFSVNYDTKS 58
SEQIDNO:10  MAAPGSARRSLLL-LLLLLLGLTH--CASAAMFIVKNGN-GTACIMANFSAAFSVNYDTKS 57
SEQIDNO:11  MAAFGGARPRPL--LLLLLAGLVH--GAAAVFVVKDAN-GTACIMANFSAAFLASYETRS 55
SEQIDNO:12  MEAPGGARRPLLLL---LLLGLVH--GASAVFVVRNSN-GTACIMANFSAVFSVIYESKS 54
SEQIDNO:13  MAAPGGARRRPLLL--LLFAGLVH--GASAVFVVKNGN-GTACIMADFSATFLTSYDTRS 55
SEQIDNO:14  MAAPGAR-RPLL---LLLLAGLAH--SAPALFEVKDNN-GTACIMASFSASFLTTYDAGH 53
SEQIDNO:15  ---------MGGAA--RAVLLGFL---QASSSFDVRDST-GKVCIIANLTVAFSVEYKSSG 46
SEQIDNO:16  MAAPGGAWRRPLLLL-LLLLGLAR--GASAVFVVSDGN-GTACIMADFAAAFEISYDSRS 56
SEQIDNO:17  MAEPGGARTPQRLL--LLLLGLIH--VASSIFVVKNGT-GTACIMANFSATFSMNYTTKS 55
SEQIDNO:18  -------MARALL--AAVLLGFL---QASSSFDVRDST-GKVCIIANLTVAFSVEYKSNG 47
SEQIDNO:19  ------MARGLLA--AAALLGFL---QASSSFEVKDSS-GKVCILADLTVAFSVEYKTNV 48
SEQIDNO:20  MVSSSSCRRGLLL--AAVLLGFL---QASSTFEVRDKT-GKICILANFSAEFTVDYSTKA 54
SEQIDNO:21  MKSFPSFVALFI-VCSAVLADT----QAVVTLEVKEGN--STCIKAEFSAVFSITYNTTN 53
SEQIDNO:22  MKRSHALVVL-I-IAWFSLSGC----IQAVSLEVKEGN--STCIKANLSAYFSITYNTSS 52
SEQIDNO:23  MTRTCPFVVG-I-AC-FAILGCVTVVQSQVTLEVTEGN--STCIKAELSASFSITYDTAN 55
SEQIDNO:24  ------------------------------------------------------------ 0

LAMP HOMOLOGY DOMAIN 1
                                          2
SEQIDNO:1   GPKNMTFDLPSDATVVLNRSSCGKENTSDPSLVIAFGRGH--TLTLNFTRNATRYSVQLM 116
SEQIDNO:6   GSQIVNISLPASAEVLKNGSSCGKENVSDPSLTITFGRGY--LLTLNFTKNTTRYSVQHM 110
SEQIDNO:7   GTSVSVFALPASASVSE-RSSCGS-AAVPPELALVFGDTHTHTLSLLFSRDQRLYRVSNI 108
SEQIDNO:8   KMELATFVLPSEAVTNINKSSCGVENTTAPVLAIQFGSNH--SLSIHFARNNTRYEVAEL 116
SEQIDNO:9   GPKNMTFDLPSDATVVLNRSSCGKENTSDPSLVIAFGRGH--TLTLNFTRNATRYSVQLM 116
SEQIDNO:10  GPKNMTFDLPSDAKVVLNSSSCGKENTSDPSLVIAFGRGQ--TLTLNFTRNATRYSVQLM 115
SEQIDNO:11  GPKNVTFDLPSDA-VVLNSSSCGKENTSDPSLMIAFGKGH--GLTLNFTRNATRYSVQLM 112
SEQIDNO:12  GYKNASFELPATA-EVQNTSSCGRENTSNPSLQIAFGRGH--VLALNFTRNATLYSVPLL 111
SEQIDNO:13  GPQNKSFELPAGA-EVSNSSSCGKENASDSSLVITFGRGH--TLTLIFTRNATRYEVQLM 112
SEQIDNO:14  VSKVSNMTLPASAEVLKNSSSCGEKNASEPTLAITFGEGY--LLKLTFTKNTTRYSVQHM 111
SEQIDNO:15  QKQFAHFFLPQNATSQ-SHSSCGEGNTSHPILALSFGAGH--LISLNFSKTLDKYQVEEL 103
SEQIDNO:16  GAKNTTFSLPASA-QVLNSSSCGKENTSDSSLVIAFGRGH--TLTLSFTRNATRYSVQLM 113
SEQIDNO:17  GLESTTFRLPQNA-SVMNSSSCGKENTSNPILEIGFGGGH--TLTMNFSSTTQSYQVELL 112
SEQIDNO:18  QKQFAHFFLPQNATSQ-SHSSCGEGNTSHPILALSFGAGH--LLSLNFSKTLDKYQVEEL 104
SEQIDNO:19  QKEFVHFFLPQNASVD-SQSSCGKDNASHPILVLDFGGGH--SLSLNFSESADKYQVEEL 105
SEQIDNO:20  KVERKTFQLPSSAHINKESSSCGKEKETSQVLVVEFGTGN--SLTFTFEKSNDFYHVSNL 112
SEQIDNO:21  DTRTVSVFLPNSTTVDSANSSCGS-NGSTPGLMAKFGPGH--YFGMNFSTNGSLYSVDTL 110
SEQIDNO:22  STRTAQFILPDSATVDPDSSTCGG-NGSSPWLVAVFGAGH--ALGLGFSTNGSFYSVANL 109
SEQIDNO:23  GTRTVMVPLPGSAVVGV-ASSCGG-DGRSPWLVALFGDGH--ALGLGFSSNDSLYSVAKL 111
SEQIDNO:24  ------------------------------------------------------------ 0
```

FIG. 3

LAMP HOMOLOGY DOMAIN 1

```
                                     3
SEQIDNO:1   SFVYNLSDTHLFPNASSK-EIKT-VESITDIRADIDKKYRCVSGTQVHMNN-VTVTLHDA 173
SEQIDNO:6   YFTYNLSDTEHFPNAISK-EIYT-MDSTTDIKADINKAYRCVSDIRVYMKN-VTVVLRDA 167
SEQIDNO:7   SLQYNLSDGDIFPQSSSAGVQSVMASVSELMSARLNSTYRCVSSSSISLSAAVNLTLSGV 168
SEQIDNO:8   VMSYNLSDKIIFPNASENGTKTV-STNKTAVLAENDTVYKCMNPHLIRMDN-ANATFHDI 174
SEQIDNO:9   SFVYNLSDTHLFPNASSK-EIKT-VESITDIRADIDKKYRCVSGTQVHMNN-VTVTLHDA 173
SEQIDNO:10  SFVYNLSDTHLFPNASSK-EIKT-VESITDIRADIDKKYRCVSGTQVHMNN-VTVTLHDA 172
SEQIDNO:11  SFIYNLSDTQIFPNASSK-ETKT-VESATDIRADINKKYRCVSNTQIHMHN-VTVTFHDV 169
SEQIDNO:12  SFVYNLSDSDLFPNASSK-DIKT-VGSTTDIKADIDKRYRCVSDSKVPMGN-VTVTLQDA 168
SEQIDNO:13  RFAYNLSDTDTFPNSSST-GVKT-VESATDIKADINKTYRCVSETQVNMDN-VTVTLRDA 169
SEQIDNO:14  YFTYNLSDTQFFPNASSK-GPDT-VDSTTDIKADINKTYRCVSDIRVYMKN-VTIVLWDA 168
SEQIDNO:15  TFHYNLSDETLFPNATEG-KVMV-ATQKSVIQARIGTEYRCINSKYVRMKH-VNITFSNV 160
SEQIDNO:16  TLVYNLSDAEFFPSASSK-GTKT-VAASTDIRADLNTKYRCVSNSQVHLLN-VTVTLGNA 170
SEQIDNO:17  SFSYNLSDATLFPNASKGSEESS-VKSKTDIQADIHKKYRCVSSNRITMSN-VTIVLSDV 170
SEQIDNO:18  TFHYNLSDETLFPNASEG-KVME-VTQKSVIQARIGTEYRCINSKYIYIRH-VNITFSNV 161
SEQIDNO:19  VFHYNLSDATLFPNSSTG-GMKT-VSHKSIIQAHMGTQYRCINSKHINMKN-VNVTFSNV 162
SEQIDNO:20  TFSYNLSDSSFFPNSSG--GQRE-VSRAGDIQANINTTYRCRSNHRVNMTN-VTVLFSNV 168
SEQIDNO:21  FLRYNLSDASLFPEANSSGPVDFELSASVGIWAPTNTTYRCLSPTTITITR-PSVTFSEM 169
SEQIDNO:22  TLQYNLSDASVFPDANSSGVVTV-VSSSVGIWAAVNTTYRCLSSVLFQVGG-ATVTFSDM 167
SEQIDNO:23  TLQYNLSDVSNFPEANSTDVVTE-TTSVGMVARVNTTYRCISASPVIVGG-ATVTFSNV 169
SEQIDNO:24  ------------------------------------------------------------ 0
```

LAMP HOMOLOGY DOMAIN 1           Hinge Region

```
                       4
SEQIDNO:1   TIQAYLSNSSFSRGETRCEQDRPSPTTAPPAP-----------PSP-SP---SPVPKSPS 218
SEQIDNO:6   TIQAYLSSGNFSKEETHCTQDGPSPTTGP--------------PSP-SP---PLVPTNPT 209
SEQIDNO:7   QMEAYMSSANLSADESVCSADQPSTTVAPPPSTT--------------TSPPPIPPVPE 213
SEQIDNO:8   RLEAYLKQSNFSQKVSTCSEDITPTSAPA-PV--T-----T-------TAPVPAP-VPDPP 219
SEQIDNO:9   TIQAYLSNSSFSRGETRCEQDRPSPTTAPPAP-----------PSP-SP---SPVPESPS 218
SEQIDNO:10  TIQAYLSNSSFSREETRCEQDRPSPTTAPPAP-----------PSP-SP---SPVPESPS 217
SEQIDNO:11  TIQAYLANSNFSKEETRCEQDGPFPTTAPPPP-----------PHP-SP---SPAPESPS 214
SEQIDNO:12  TIQAYLWNNSFSQAESRCRQDMPSPTTAPPAPPVP------PSPPSP-SP---PPKPESPS 219
SEQIDNO:13  AIQAYLSSSNFSREETRCEQDLPT----------P-----TTPPQP-AP---TPAPASPA 210
SEQIDNO:14  TIQAYLPSSNFSKEETRCPQDQPSPTTGP--------------PSP-SP---PLVPTNPS 210
SEQIDNO:15  TLEAYPTNDTFSANKTECREDMVSTTTVAPTTPKH-----ATSQVPTTSPAPTAAPSSPA 215
SEQIDNO:16  TIQAYLANNSFSQQETRCEQDKPSP-------PTP------TAPPTP-TP----TPAPTSPV 214
SEQIDNO:17  TIQAYLSNNTFSKEETRCSQDTPSPSPVPTTHPTT------IPVPTP-TPTRPPTPAEIPP 224
SEQIDNO:18  TLEAYPTNGTFSTNKTECSEDMVSTTTVAPTTPKH-----ITSQVPATSPAPTAAPSNPA 216
SEQIDNO:19  TLEAYLTNGTLSVNKTECAEDRVSTTTMVPTTPKQ-----TTSQSPTTGPAPTS-PPNPT 216
SEQIDNO:20  TLEAYLPNNAFSKNDSVCAEDKTSTVA--PPITTH-----IPTTTSLAPPT-PPPTDTPK 220
SEQIDNO:21  KLEAYMPGNDFSPAERVCAADQTTTGAPTTTT---------SAATP-TT-PSPTPAGTPE 218
SEQIDNO:22  RLEAYMPGNDLSPRESFCAADQTTTAPPTTTAAP----TTTAATTM-AP-PAPTPPGTPV 221
SEQIDNO:23  TMEAFMTGEDLSPNESVCTADQSFTTAPPPPPS--------TTTAA-PA-PVPTPPGTPS 219
SEQIDNO:24  --------------MVQICRVQSWFVGVTPLLIFATVLHQGFATVAP-PTPAPHKEPGRPE 46
                          *        :                                   *
```

FIG. 3 (cont.)

```
                    Hinge            LAMP HOMOLOGY DOMAIN 2
                           1                           2
SEQIDNO:1    VDKYNVSGTNGT-CLLASMGLQLNLTYE-RKDNTTVTRLLNINPNKTSASGSCGAHLVTL 276
SEQIDNO:6    VSKYNVTGNNGT-CLLASMALQLNITYL-KKDNKTVTRAFNISPNDT-SSGSCGINLVTL 266
SEQIDNO:7    RGNYSVTDGNGTVCVLALMGLQLNITHT-TTQNQSVSELMNLQPNQTTVSGSCGVTESSL 272
SEQIDNO:8    VVQYSVNRSSEP-CLLAKVGLQMNITYT-TKDGKNGSYVFNIESKGVTVDGNCTNTTAYL 277
SEQIDNO:9    VDKYNVSGTNGT-CLLASMGLQLNLTYE-RKDNTTVTRLLNINPNKTSASGSCGAHLVTL 276
SEQIDNO:10   VDKYNVSGTNGT-CLLASMGLQLNLTYE-RKDNTTVTRLLNINPNKTLASGSCGAHLVTL 275
SEQIDNO:11   VHKYNVSGANGT-CLLASMGLQLNVTYK-KKDNTTVVKVVSINPNKTTAGGSCGAQLVTL 272
SEQIDNO:12   VSRYNVSDGNAT-CLLASMGLQLNLTYV-HRDNATVTRVFNINPNKTKPSGHCGAQQVTL 277
SEQIDNO:13   VFRYNVSGSNGT-CLLASMGLQLNVTYR-RVDNKTVTREFNVNPNKTTFGGNCSATLATL 268
SEQIDNO:14   VSKYNVTGDNGT-CLLASMALQLNITYM-KKDNTTVTRAFNINPSDK-YSGTCGAQLVTL 267
SEQIDNO:15   VGKYNVTGANGT-CVLASMGLQLNITYV-KKDEKMGLDLLNFIPHNTSASGMCESTSAFL 273
SEQIDNO:16   VSRYNVSGANGT-CLLASMGLQLNVTYR-TKDNTTVTRGLNINPNKTTFGGSCSAQLVTL 272
SEQIDNO:17   IFKYNVSDANGT-CLLASMGLQLNITYA-KKDNSSARIIWNINPNKTVAGGSCSPQVAIL 282
SEQIDNO:18   VGKYNVTGANGT-CVLASMGLQLNITYL-KKDGKTGLDLLNFVPHNTNASGTCENTSAFL 274
SEQIDNO:19   VGKYNVTGPNGT-CVLAYMGLQLNITYQ-QKDEKMGLDLLNFVPHNTTSSGRCDNTSALL 274
SEQIDNO:20   IGRYNVTGLHGI-CLLATMGLQVNVTYS-TKNKTSKSELLNLPP-TAEVSGTCENSSITL 277
SEQIDNO:21   QGSYSVKNASGTVCLMAKMGVQLNVSYFSQSQNKTVQELLNLTPNLTSSSGLCGGTNATL 278
SEQIDNO:22   RGTYSVVNGNDTTCLLAQMGLQLNVSYFSRSQNKTVQSLVNLTPNLTNSTGSCEKGSATL 281
SEQIDNO:23   QGSYSVSNSNGTVCLLARMALQLNISHFSASQNKTIQEVVNLLPNQTTSSGSCDPTSATL 279
SEQIDNO:24   RGYYNVTNHNGTICLMAYMGLQLNISYNSTSQKKVVQDVMNLQPNLTKHSGLCDSDIASL 106
              *.*        *::*  :.:*:*:::     :        ..       * *      *

LAMP HOMOLOGY DOMAIN 2

SEQIDNO:1    ELHS-EGTTVLLFQFGMNASSSRFFLQGIQLNTILP-DARDPAFKAANGSLRALQATVGN 334
SEQIDNO:6    KVEN-K-NRALELQFGMNASSSLFFLQGVRLNMTLP-DALVPTFSISNHSLKALQATVGN 323
SEQIDNO:7    RLSD--ETTNLTFSFTMNSTTQKYYLSAVSVSALWP-DMS-VVFEAGNTSLSALQCSVGR 328
SEQIDNO:8    SLST-GS-IDLRFNFTLNSSLEVFYLDGVSLSTGLPADANDTHFEAANSSLNYMQTNVHK 335
SEQIDNO:9    ELHS-EGSTVLLFLFGMNASSRFFLQGIQLNTTLP-DARDPAFKAANGSLRALQATVGN 334
SEQIDNO:10   ELHS-EGSTVLLFQFGMNASSRFFLQGIQLNTTLP-DARDPAFKAANSSLRALQATVGN 333
SEQIDNO:11   ELRS-ESVTLLAFQFGMNASTRFFLQGIQLNMTLP-DARDPTFKAGNNSLRALQATIGN 330
SEQIDNO:12   ELQS-ERSTVLVFQFGMNASSGQYFLQGVLLNTTLP-DAREPAFSASNSSLRALQATLGN 335
SEQIDNO:13   ELHS-ENLLLLALQFVMNESSSRVFLQGVQLNLTLP-DAKEGSFTATNSSLRALQATAGN 326
SEQIDNO:14   KVGN-K-SRVLELQFGMNATSSLFFLQGVQLNMTLP-DAIEPTFSTSNYSLKALQASVGN 324
SEQIDNO:15   NLAF-EK-TKITFHFVLNASSEKFFLQGVNVSTTLPSEAKAPTFEASNDSMSESRATVGN 331
SEQIDNO:16   ELQG-ESLRLLALQFALNTSSSRVFLQGVQLNMTLP-DARDPSFSAANSSLRALQATAGN 330
SEQIDNO:17   ELQT-EN-STLAFSFGMNATTSKFFLREIRFHKFFP-DAKDPAFGAVNSSLKELQATVGN 339
SEQIDNO:18   NLAF-EK-TKITFHFVLNASSEKFFLQGVNVSTTLPSEAKAPMFEASNDSMSELRATVGN 332
SEQIDNO:19   NLTF-EK-TRVIFQFALNATAEKFFLQGVSVSTTLPSEAKNPKFEATNNSMSELRASVGN 332
SEQIDNO:20   NLTS-ES-TSLSFQFSQNTSTEKYFLQGIIVTANLPPEATEKNISYSNHTLNALKTSVGK 335
SEQIDNO:21   VLAQ-EETTVLSFLFTVNSTSNKYHLSGITLQANWT-DMM-SPFSASNTSLDYLRSSLGH 335
SEQIDNO:22   ILTQ-Q-TTILIFTFSLNSTSSKYHLSGLSLQANWS-DMA-AAFSASNASLSYLRSTFGH 337
SEQIDNO:23   VLTQ-ANATNLSFLFTLNSTSNRYHLTGLSVVAAWS-DMT-APFNTSNSSLDYQRGSLGR 336
SEQIDNO:24   NLTVDAVKTNLTFVFTMNSTSNKYHLSEVTVSAAWP-EMK-EPVSHNSSLDYLRGTVGY 164
                :         : :*    * :   .*  :.     :       .  * ::    : .
```

FIG. 3 (cont.)

```
                        LAMP HOMOLOGY DOMAIN 2              Trans. Domain
                    3                                   4
SEQIDNO:1   SYKCNAEEHVRVTKAFSVNIFKVWVQAFKVEGGQFGSVEECLLDENSMLIPIAVGGALAG 394
SEQIDNO:6   SYKCNTEEHIFVSKMLSLNVFSVQVQAFKVDSDRFGSVEECVQDGNNMLIPIAVGGALAG 383
SEQIDNO:7   SYVCSAQQMLSVTPVFSINTFRLQLQPFNITANRFSTAEECRVDQENMLIPIIVGAALAG 388
SEQIDNO:8   SFKCNSKQTLQITDPFTVNTYHLQVQAFNSD-NTFASAVECSLDENGMLVPIVVGAALAG 394
SEQIDNO:9   SYKCNAEEHVRVTKAFSVNIFKVWVQAFKVEGGQFGSVEECVLDENNMLIPIAVGGALAG 394
SEQIDNO:10  SYKCNAEEHVRVTKAFSVNIFKVWVQAFKVEGGQFGSVEECLLDENNMLIPIAVGGALAG 393
SEQIDNO:11  SYKCNAGEHVQVTEAFSVNIIKVWVQAFQVQGDKFGSVEECQLDENSMLIPIAVGGALAG 390
SEQIDNO:12  SYKCNSEEHVRVTPAFSLSIFKVWVQAFQVKGDKFGSVEECLLDQDSMLIPIAVGGALAG 395
SEQIDNO:13  SYKCNAEQRLRVTSSFSLNMFRVWLQAFRVDGDKFGPVEECQLDENSMLIPIAVGGALAG 386
SEQIDNO:14  SYKCNSEEHIFVSKALALNVFSVQVQAFRVESDRFGSVEECVQDGNNMLIPIAVGGALAG 384
SEQIDNO:15  SYKCSAEENFQVTDKALVNVFNVQVQAFKVDGDKFGAMEECQLDENNMLIPIIVGAALAG 391
SEQIDNO:16  SYKCRSEQRLQVTEAFALNVFQVRVQAFRVDGDKFGPAEECQLDENSMLIPIAVGGALAG 390
SEQIDNO:17  SYKCNAEENVHVTDGFSVNIFRVRVQAFKVEGDKFGSVEECLLDENNMLIPIAVGGALAG 399
SEQIDNO:18  SYKCSAEENLQVTDKALVNVFNVQVQAFKVDGDKFGAVEECQLDENNMLIPIIVGAALAG 392
SEQIDNO:19  SYKCSSEENLQVTDQALVNVFNVQVQIFKIDGDKFGPVEECQLDENNMLIPIIVGAALAG 392
SEQIDNO:20  SYKCIAEESIWISGKAAVNIFNIQLQAFKIPGDKFGAVEECQLDENNMLIPIIVGAALAG 395
SEQIDNO:21  SYMCNAEQTLFVVSTFSINMFELQVQPFGVTSTQFASAEVCQIDQDQMLIPIIVGAALAG 395
SEQIDNO:22  SYMCNAEQILAVTPVFSLNTFSLQIQPFGVTTNQFAAAEECQMDQDQMLIPIIVGASLAG 397
SEQIDNO:23  SYMCISEQTLVVDQNFSLNTFQLQVQPFGITRGQFAQAEECQLDQDNMLIPIVVGAALAG 396
SEQIDNO:24  SYFCRDEQTLNVAQNLSINTFQLQVQPFAVKGDQFGAAEECQLDEDDMLIPIVVGAALAG 224
             *: *     : . :       :.   : :*  *      *.    *  * ; **:** **.:***

Cytoplasmic Tail

SEQIDNO:1   LVLIVLIAYLVGRKRSHAGYQTI  417
SEQIDNO:6   LVLIVLIAYLIGRKRSHAGYQTI  406
SEQIDNO:7   LVLIVLVAYLIGRKRTHAGYQTI  411
SEQIDNO:8   LVLIVLIAYLIGRKRSHAGYQTI  417
SEQIDNO:9   LVLIVLIAYLVGRKRSHAGYQTI  417
SEQIDNO:10  LVLIVLIAYLVGRKRSHAGYQT-  415
SEQIDNO:11  LVLIVLIAYLIGRKRSHAGYQTI  413
SEQIDNO:12  LVLVVLIAYLIGRKRSHAGYQT-  417
SEQIDNO:13  LVLIVLLAYLIGRKRSHAGYQTI  409
SEQIDNO:14  LVLIVLIAYLIGRKRSHAGYQTI  407
SEQIDNO:15  LVLIVLIAYLIGRKRSHAGYQTI  414
SEQIDNO:16  LVLVVLMAYLVGRKRSHAGYQTI  413
SEQIDNO:17  LVLIVLIAYLIGRKRSHAGYQTI  422
SEQIDNO:18  LVLIVLIAYLIGRKRSHAGYQTI  415
SEQIDNO:19  LVLIVLIAYLIGRKRSHAGYQTI  415
SEQIDNO:20  LVLIVLIAYLIGRKRSHAGYQTI  418
SEQIDNO:21  LVLIVLIAYLIGRKRSHAGYQTI  418
SEQIDNO:22  LVLIVLIAYLIGRKKSHAGYQTI  420
SEQIDNO:23  LVLIVLIAYLIGRKRSHAGYQTI  419
SEQIDNO:24  LVVIVLLAYLIGRKRSHAGYQSI  247
             **::**:***:***::*****:
```

FIG. 3 (cont.)

| LAMP-1 |||||||
| --- | --- | --- | --- | --- | --- |
| Accession No. | Species | SEQ ID NO: | Accession No. | Species | SEQ ID NO: |
| NP_005552.3 | H. sapiens | 1 | NP_990614.1 | G. gallus | 15 |
| NP_034814.2 | M. musculus | 6 | NP_001011507.1 | S. scrofa | 16 |
| NP_955996.1 | D. rerio | 7 | XP_001374132.1 | M. domestica | 17 |
| NP_001087042.1 | X. laevis | 8 | XP_003203252.1 | M. gallopavo | 18 |
| NP_001233491.1 | P. troglodytes | 9 | XP_002191607.2 | T. guttate | 19 |
| XP_001087801.1 | M. mulatta | 10 | XP_003218797.1 | A. carolinensis | 20 |
| XP_534193.2 | C. lupus familiaris | 11 | XP_004067118.1 | O. latipes | 21 |
| XP_002723509.1 | O. cuniculus | 12 | XP_003969941.1 | T. rubripes | 22 |
| NP_001068592.1 | B. taurus | 13 | NP_001158846.1 | S. salar | 23 |
| NP_036989.1 | R. novegicus | 14 | XP_003452974.1 | O. niloticus | 24 |

FIG. 3 (cont.)

HUMAN LAMP-2 ALIGNMENT WITH ORTHOLOGOUS SEQUENCES

```
SEQIDNO:2   ---------------------------------------------------------- 0
SEQIDNO:25  ---------------------------------------------------------- 0
SEQIDNO:26  ---------------------------------------------------------- 0
SEQIDNO:27  ---------------------------------------------------------- 0
SEQIDNO:28  ---------------------------------------------------------- 0
SEQIDNO:29  ---------------------------------------------------------- 0
SEQIDNO:30  ---------------------------------------------------------- 0
SEQIDNO:31  ---------------------------------------------------------- 0
SEQIDNO:32  ---------------------------------------------------------- 0
SEQIDNO:33  ---------------------------------------------------------- 0
SEQIDNO:34  ---------------------------------------------------------- 0
SEQIDNO:35  ---------------------------------------------------------- 0
SEQIDNO:36  ---------------------------------------------------------- 0
SEQIDNO:37  MAMKNFTLQQERDTSVALIIRTYVRAFLKVYTKVPKPQRCHNQW---QSLNIEGIEGIEI 57
SEQIDNO:38  ---------------------------------------------------------- 0
SEQIDNO:39  ------------------------------MECREGEVTRCKQKNNLFSGIN-DDISGAKQ 30
SEQIDNO:40  ---------------------------------------------------------- 0
SEQIDNO:41  ---------------------------------------------------------- 0
SEQIDNO:42  ---------------------------------------------------------- 0
SEQIDNO:43  ---------------------------------------------------------- 0

SEQIDNO:2   ---------------------------------------------------------- 0
SEQIDNO:25  ---------------------------------------------------------- 0
SEQIDNO:26  ---------------------------------------------------------- 0
SEQIDNO:27  ---------------------------------------------------------- 0
SEQIDNO:28  ---------------------------------------------------------- 0
SEQIDNO:29  ---------------------------------------------------------- 0
SEQIDNO:30  ---------------------------------------------------------- 0
SEQIDNO:31  ---------------------------------------------------------- 0
SEQIDNO:32  ---------------------------------------------------------- 0
SEQIDNO:33  ---------------------------------------------------------- 0
SEQIDNO:34  ---------------------------------------------------------- 0
SEQIDNO:35  ---------------------------------------------------------- 0
SEQIDNO:36  ---------------------------------------------------------- 0
SEQIDNO:37  VKGSKWR---SALETIITIQVKRK---------------SQVQKYHPFSLHSECQKTNQE 99
SEQIDNO:38  ---------------------------------------------------------- 0
SEQIDNO:39  AKQRQCTPQKPPKRATATLPLQRPPRGIPGPAPAAVAAAVAADRITPSGSHQTRPPEAAR 90
SEQIDNO:40  ---------------------------------------------------------- 0
SEQIDNO:41  ---------------------------------------------------------- 0
SEQIDNO:42  ---------------------------------------------------------- 0
SEQIDNO:43  ---------------------------------------------------------- 0
```

FIG. 4

```
SEQIDNO:2   ------------------------------------------------------MVCF 4
SEQIDNO:25  ---------------------------------------------------------M 1
SEQIDNO:26  ------------------------------------------------------MGDT 4
SEQIDNO:27  ---------------------------------------------------------- 0
SEQIDNO:28  ------------------------------------------------------MVCF 4
SEQIDNO:29  ------------------------------------------------------MVCF 4
SEQIDNO:30  ------------------------------------------------------MVCF 4
SEQIDNO:31  ------------------------------------------------------MVCF 4
SEQIDNO:32  ------------------------------------------------------MVCF 4
SEQIDNO:33  ------------------------------------------------------MVCF 4
SEQIDNO:34  ------------------------------------------------------MVCF 4
SEQIDNO:35  ------------------------------------------------------MVCF 4
SEQIDNO:36  --------------------------------------------------------MR 2
SEQIDNO:37  G---TGGVATVIADECLLWPSIPFSTLAQKVNLGSCEAFSIIGYSVFALFIYLKPNMLDF 156
SEQIDNO:38  ---------------------------------------------------------- 0
SEQIDNO:39  DERPVRDPRNRAAAPSGHWRRAGGPQRHR------HHR-----------HRRHGPAPLRR 133
SEQIDNO:40  ---------------------------------------------------------- 0
SEQIDNO:41  ---------------------------------------------------------- 0
SEQIDNO:42  ---------------------------------------------------------- 0
SEQIDNO:43  ---------------------------------------------------------- 0

SIGNAL SEQUENCE        LAMP HOMOLOGY DOMAIN 1
                                                        1
SEQIDNO:2   -RL----FPVPGSGLVLVCLVLGAVR--SYALELNLTDSENATCLYAKWQMNFTVRYETT 57
SEQIDNO:25  -CL----SPVKGAKLILIFLFLGAVQ--SNALIVNLTDS-KGTCLYAEWEMNFTITYETT 53
SEQIDNO:26  GAM--ERCACPAAVLLLSLVL---MG--ATAFEVEIKDDKNATCIYAKLSVNITVQYETD 57
SEQIDNO:27  --------MAVRGFLPLLFILLSGIVHADDMMTSPLPS---------------TAELK 35
SEQIDNO:28  -RL----FPVPGSGLVLVCLVLGAVQ--SYALELNLTDSGKATCLYAKWQMNFTVRYETT 57
SEQIDNO:29  -RL----FPVPGSGLVLVCLVLGAVQ--SYALELNLTDSGKATCLYAKWQMNFTVRYETT 57
SEQIDNO:30  -RL----FPVPGSGLVLVCLVLGAVR--SHALELNEADSAIN------------------ 39
SEQIDNO:31  -RL----SPAPGSGLVLLCLVLGAVS--SYALEVNVTDSEKATCLYAKWQMNFTIQYNTT 57
SEQIDNO:32  -RL----SPVPGSGLVLLCLVLGAVS--SYALELNLTDSEKALCLYAKWQMNFTIPYETT 57
SEQIDNO:33  -RL----APVPGSFLLLCLVLGAVS--SYALELNLTDSSNATCLYAKWQMNFTIRYETT 57
SEQIDNO:34  -RL----SPVPGSGLLMLCLVLGAVS--SYALELNLTNSEKATCLYAKWQMNFTIRYETT 57
SEQIDNO:35  -RL----APVPGCGFLLFCLVLGTVS--SYALELNLTDSSKATCLYAKWQMNFTIRYETT 57
SEQIDNO:36  -LL----SPVTGSKLVLLFLFLGAVR--SDALKLNLTDS-KGTCLYAEWEMNFTITYEAL 54
SEQIDNO:37  IELAELMLSTETQLLEPTRVCCGICQ--SYALEINLTDSKNATCLYSKWQMTFTINYETT 214
SEQIDNO:38  --MAPPRCPAGLALLLLLLGACGFFQ--SYAVEVDVKDASNFTCLYAQWMMKFLIKYETN 56
SEQIDNO:39  LLLRPPP-PAA-----AAARFLGFFQ--SYAVEVDIKDASNATCLYADWMMRFLIKYESN 185
SEQIDNO:40  --M--ERCACPAALLLLSLVL---MG--AMAFDVEIKDDKNATCIYAKLSVNVTVQYETN 51
SEQIDNO:41  --------MF-RCAFLILFLALGNELHLSHGTEVSVNNTENKLCLYANLMVNFSVTYEVG 51
SEQIDNO:42  -----MKVSHATAGLVVWFVVLGCIDAVT----L-EVKESNTTCIKADLSASFSIIYNTT 50
SEQIDNO:43  ---------------------------------------------------------- 0
```

FIG. 4 (cont.)

LAMP HOMOLOGY DOMAIN 1
2

```
SEQIDNO:2   NKTYKTVTISDH--GTVTYNGSICGDDQNGPKIAVQFGPGFS-WIANFTKAA---STYSI 111
SEQIDNO:25  NQTNKTITIAVP--DKATHDGSSCGDDRNSAKIMIQFGFAVS-WAVNFTKEA---SHYSI 107
SEQIDNO:26  TSSSKNITFPVP--SDVTTNGSSCGSDGKAPLLVINFGNSQS-WSLNFTRNN---STYSG 111
SEQIDNO:27  ---T----ANLP--LVIQTTSSTTSTTTT-SRP--SSTSTHSTLTTEPAA----------  73
SEQIDNO:28  NKTYKTVTISDR--GTVTYNGSICGDDQNGPKIAVQFGPGFS-WIANFSKAA---STYSI 111
SEQIDNO:29  NKTYKTVTISDR--GTVTYNGSICGDDQNGPKIAVQFGPGFS-WIANFSKAA---STYSI 111
SEQIDNO:30  CSKCKTVTISDH--GTVTYNGSICGDDQNGPKIAVQFGPGFS-WIANFTKAA---STYSI  93
SEQIDNO:31  SKNFKTATISDF--STATYNGSVCGNDQNNPKIVVQFGSGFS-WIVNFTKKE---SAYLI 111
SEQIDNO:32  SKSYKTVTISNF--GTPTYNGSICGDNQNGSRIAVQFGSGFS-WIVNFTKSV---SVYSI 111
SEQIDNO:33  DKHNKTVPISDL--GAATYNGSFCGDDQNGPKIAVQFGSGFS-WIVNFTKEAASPSTYLV 114
SEQIDNO:34  NNSHKTVSISDF--GAATYNGSFCGDDHNDPQIVMQFGSGFS-WIVNFAKES---SSYLI 111
SEQIDNO:35  DKHNKTVTISDF--DAAAYNGSVCGDDQNGPKIAVQFGSGFS-WIVNFTKEASSTSTYLV 114
SEQIDNO:36  K-VNETVTITVP--DKVTYNGSSCGDDKNGAKIMIQYGSTLS-WAVNFTKEA---SQYFI 107
SEQIDNO:37  GNETKNVTVTVP--ENVTYDGSSCGDNQTVPQIAVQFGLGYS-WHLNFTKKEN--NSYSF 269
SEQIDNO:38  SSDYKNASLDLT--STVTHNGSICGSDTQAALLAVQFGDGHS-WSINFTKNN---ETYRA 110
SEQIDNO:39  SGDYKTTTLNLS--SSVTHNGSVCGNDTQAALVAVQFGEGHS-WSINITKNN---ETYQG 239
SEQIDNO:40  TSSTKNVTFSVP--SEVTTNGSSCGSNGKAPILVINFGNGHS-WSLNFTRND---SMYSG 105
SEQIDNO:41  VNKNETVIFVLP--ENVTTEGSTCDNTTSTLKL--SFGHGHS-WTVEFTKKN---KTYQV 103
SEQIDNO:42  HAER-TVQVLLPNSTTVDTANSTCGKDGSSPRLVAVFGSGY-TLGLNFSTNG---TLYQV 105
SEQIDNO:43  ------------------------------------------------------------   0
```

LAMP HOMOLOGY DOMAIN 1
3

```
SEQIDNO:2   DSVSFSYNTGDNTTFPDAEDKGI-LTVDELLAIRIPLNDLFRCNSLSTLEKNDVVQHYWD 170
SEQIDNO:25  HDIVLSYNTSDSTVFPGAVAKGV-HTVKNPENFKVPLDVIFKCNSVLTYNLTPVVQKYWG 166
SEQIDNO:26  SALIFTYNDTILFPDALRKGLIS-STAMFLGPVPLNSTYKCISREVVVSENVTQIIYD 170
SEQIDNO:27  ----------------------KTTTARTTVTTSA---PTSTQSTSSSSTSATVTTLAP 107
SEQIDNO:28  DSISFSYNTGDNTTFPDAEDKGI-ITVDELLAIKIPLNDLFRCNSLSTLEKNDVVQNYWD 170
SEQIDNO:29  DSISFSYNTGDNTTFPDAEDKGI-ITVDELLAIKIPLNDLFRCNSLSTLEKNDVVQNYWD 170
SEQIDNO:30  DSISFSYNTGDNTTFPDAEDKGI-LTVDELLAIKIPLNDLFRCNSLSTLEKNDVVQHYWD 152
SEQIDNO:31  DSISFSYNLSDNATFPDAKEKGI-LTVHDLVGFRIPLNNIFRCNSLSTLEKNGVVQYYWD 170
SEQIDNO:32  DSISFSYNTGDNTTFPDAKDKGI-LTVNESVAFKIPLNDIFRCNSLSSLVKNGVVQNYWD 170
SEQIDNO:33  DTISFSYNTNDNKTFPDAKEKEV-FTVNNRVALKIPLNDIFRCNSLSTLENRDVVQHYWD 173
SEQIDNO:34  NSISFSYNTSDTTTFPDAKKKGV-LTVNDSVGFQVPLNDIFRCNSLSTLEKDNVVQHYWD 170
SEQIDNO:35  DSISFSYNTNDNATFPDAKEKGV-FTVNNRVALKIPLNDIFRCNSLSTLEKSDVVQHYWD 173
SEQIDNO:36  NNITLSYNTNDTKTFPGAVPKGI-LTVIIPVGSQLPLGVIFKCSSVLTFNLSPVVQHYWG 166
SEQIDNO:37  DTIVFTYNTSDNETFPEAKEKGQVLSVFEFRYARIPLNKIFRCHSEESLIGDKATHHYWE 329
SEQIDNO:38  EFITFTYNTNDTAVFPDARRQGPVTIVVKDAMHPIQLNNVFVCHHTTSLEAENVTQIFWN 170
SEQIDNO:39  DFITLTYNTNDTAVFPDAKRKGPITVLVRDPSRPIQLNTVFVCHNSFVIEAENTTQIFWN 299
SEQIDNO:40  GALIFTYNTNDSTLFPDALKEGLIS-STAAFLGPIPLNSTYKCISSEVVVSENVTQIISD 164
SEQIDNO:41  DTIVFSYNLNDSSVFPNSTSKETKFVTVKSIITNVSVDTYYSCKSENVLTVESVIQTLYD 163
SEQIDNO:42  SSLTLQYNLSDTSVFPNATISGVVTLVSASVGIEANVNTTYKCASPTVIDVATAKVNFTD 165
SEQIDNO:43  ---------------------------------------------MTQIGGVQPVFLA  13
```

FIG. 4 (cont.)

```
              LAMP HOMOLOGY DOMAIN 1            Hinge Region
                        4
SEQIDNO:2    VLVQAFVQNGTVSTNEFLCDKDKTS---TVAPTIHTTVPS------PTTTPT--PKEKPE 219
SEQIDNO:25   IHLQAFVQNGTVSKNEQVCEEDQTP--TTVAPIIHTTAPSTTTTLTPTSTPTPTPTPT 224
SEQIDNO:26   VKLEAFMANGTLGK-EIICDADKPS--PVPSPTQPST-----TASTAIPAPTSKPLDKPT 222
SEQIDNO:27   TTTGHNTTNSTTEPPTTTGHNTTNS--TTDAPTTTHTNAT----VAPTPPPTTPSVPKPT 161
SEQIDNO:28   VLVQAFVQNGTVSTNEFLCDEDKTS---TVAPTIHTTVPS------PTTTPT--PKEKPE 219
SEQIDNO:29   VLVQAFVQNGTVSTNEFLCDEDKTS---TVAPTIHTTVPS------PTTTPT--PKEKPE 219
SEQIDNO:30   VLVQAFVQNGTVSTNEFLCDKDKTS---TVAPTVHTTVPS------PTTTPT--RIP--- 198
SEQIDNO:31   VHVQAFVQNGTVSTKEFLCEKDKTS--TTVVPTISTTTPS------PTTTPT--PKEKPE 220
SEQIDNO:32   VHVQAFVQNGTVSTNEYLCEKDNTT--TTVAPIVPTTVPSPTTTSSPTTTPS--PKEKPD 226
SEQIDNO:33   VHVQAFVQNGTVSTTEFLCDKDKTV--TTAVPIVPTTLPS------PT---------KPV 216
SEQIDNO:34   VHVQAFVQNGTVSTKEFLCDKDKTL--TTTVPVIPTSVPS------PTTTPT--PKEKPE 220
SEQIDNO:35   VHVQAFVQNGTVSTTEFLCDKDKTV--TTAMPIVPTTAPS------PT---------KPV 216
SEQIDNO:36   IHLQAFVQNGTVSKHEQVCKEDKTA--TTVAPIIHTTVPSPTTTLTPTSI----PVPTPT 220
SEQIDNO:37   TVVQAFIQNGTISKEEFICSKDRAS--TTVAPVTTQVVPS--------TTATPVPQDKPY 379
SEQIDNO:38   VTMQPFVQNGTISKKESRCYADTPTAAPTVLPTVANVTTAS-TTISPAPTTAPKPAENPV 229
SEQIDNO:39   VTMQAFVQNGTVSKKESRCPADTPTSEPTVPPTIANVTTASTTTLSPAPTTAPKPVENPV 359
SEQIDNO:40   VKLEAFMQNGTLGK-EVSCDADKPS--PTPT-TNPST-----TASTTTPTPTSKPLDNPT 215
SEQIDNO:41   VALQAFVINGSKSDTDTVCSADMTS--TTVAPTT----TV----TSTAAPTSTPTLPTPT 213
SEQIDNO:42   MRLEAYMPGNELSPNETVCFADQTS--TTPSPTTVSTTAV----PTQT----P--PGTPQ 213
SEQIDNO:43   VTVHLIL--------ATV--LHQTF--AT---VTPPVTTA----VPHK----E--PGRPD 48

Hinge                LAMP HOMOLOGY DOMAIN 2
                    1                                  2
SEQIDNO:2    AGTYSVNNG--NDTCLLATMGLQLNITQ------DKVASVININPNTTHSTGSCRSHTAL 271
SEQIDNO:25   VGNYSIRNG--NTTCLLATMGLQLNITE------EKVPFIFNINPATTNFTGSCQPQSAQ 276
SEQIDNO:26   MGNYTVSDA--SGICLLASMGLQINTSLL--SEGKNIWRPFNIDPLGIKTNGTCTNQTGT 278
SEQIDNO:27   VGNYSVKTD-NVSDCLLAKMGLQFSFKIS----GNASLQTVNLDPNVTKVNGTCGSGGSD 216
SEQIDNO:28   AGTYSVNNG--NDTCLLATMGLQLNITQ------DKVASVININPNTTHSTGSCRSHTAL 271
SEQIDNO:29   AGTYSVNNG--NETCLLATMGLQLNITQ------DKVASVININPNTTHSTGSCRSHTAL 271
SEQIDNO:30   ----------------------------------PXVASVININPNTTHSTGSCRSHTAL 224
SEQIDNO:31   VGSYSVNNS--NGTCLLATMGLQLNITH------NKVASVININPNTTDFTGSCQPQTAL 272
SEQIDNO:32   VGSYLVKNG--SDTCLLATMGLQLNVTH------DKVASVININPNVGYSGSCHPQTAL 278
SEQIDNO:33   VGSYSVVNS--NGTCLLATMGLQLNITH------DKVASVFNINPNTTNATGSCQPQTAL 268
SEQIDNO:34   TGSYSVTSS--NGTCLLANMGLQLNITQ------DKVASVININPNTTNATGNCHSKTAL 272
SEQIDNO:35   VGSYSVVNS--NGTCLLATMGLQLNITH------DKVASVFNINPNTTNATGSCQPQTAL 268
SEQIDNO:36   VGNYTISNG--NATCLLATMGLQLNITE------EKVPFIFNINPATTNFTGSCQPQTAQ 272
SEQIDNO:37   PGKYAVKNG--NDTCLLATMGLQLNVTQ------NKVNSVININPNVTDFTGSCSNETAE 431
SEQIDNO:38   TGNYSLKTG--NKTCLLATVGLQLNISQ------DK-PLLINIDPKTTHADGTCGNTSAT 280
SEQIDNO:39   TGNYSLKSG--NKTCFLATVGLQLNVSQ------EK-PLLININPKTTVADGACGNTTAT 410
SEQIDNO:40   TGNYSVSDV--NGTCLLASMGLQINTSLL--SEGKNIWTAFNIDPTAMSKNGTCSNQTGT 271
SEQIDNO:41   TGKYSIAPDVNSTACLMATFGLQIGYKQG----D--KEETINLVPNITEVGGACGANSS- 266
SEQIDNO:42   QGNYTVKDA-NDTICLLAKMGLQLNVSYT--SQNKTVQDVLNLNPNVTNSTGSCGASSAT 270
SEQIDNO:43   QGDYQVTSS-NGTVCFLASMGLQLNITFNSTSQNKTLQEVINIQPNRTKSSGSCDTSSAL 107
                                 .*: *        * *              .
```

FIG. 4 (cont.)

LAMP HOMOLOGY DOMAIN 2

```
SEQIDNO:2    LRLNS-STIKYLDFVFAVKNE----NRFYLKEVNISMY-LVNGSV-FSIANNNLSYWDAP 324
SEQIDNO:25   LRLNN-SQIKYLDFIFAVKNE----KRFYLKEVNVYMY-LANGSA-FNISNKNLSFWDAP 329
SEQIDNO:26   LILTE--NRTIIEFTFALKNK----NHFYLEEVNITLI---NGSAFSSRQNQNLSTWEAS 329
SEQIDNO:27   SSLFLTS--KDITVHFVFTNDS---QKFRLHALTLTVD-LGNG-NIFNDSNTNLSLWEAS 269
SEQIDNO:28   LRLNS-STIKYLDFVFAVKNE----NRFYLKEVNVSMY-LVNGSV-FSIANNNLSYWDAP 324
SEQIDNO:29   LRLNS-STIKYLDFVFAVKNE----NRFYLKEVNVSMY-LVNGSV-FSIANNNLSYWDAP 324
SEQIDNO:30   LRLNS-STIKYLDFVFAVKNE----NRFYLKEVNISMY-LVNGSV-FSIANNNLSYWDAP 277
SEQIDNO:31   LRLNS-SNIKYLDFVFAVKNE----NRFYLKEVNVSMY-LVNGSV-FSIANNNLSYWDAP 325
SEQIDNO:32   LRLNS-SNIKYLDFVFAVKNE----NRFYLKEVNVSMY-LANGSV-FSFANNNLSYWDAP 331
SEQIDNO:33   LRLSS-SNIKYLDFVFAVKNE----NRFYLKEVNVSMI-LVNGSV-YSISNTNLSYWDAP 321
SEQIDNO:34   LRLSG-SNIKYLDFVFAVKND----NRFYLKEVNVSVY-LVNGSV-FSIANNNLSYWDAP 325
SEQIDNO:35   LRLSS-SNIKYLDFVFAVKNE----NRFYLKEVNVSMI-LVNGSV-YSISNTNLSYWDAP 321
SEQIDNO:36   LRLNN-SQIKYLDFIFAVKNE----KRFYLKEVNVNMY-LANGSA-FHVSNNNLSFWDAP 325
SEQIDNO:37   LRLSG-SNVKYIDFIFAVKNG----NRFYLKEVNVSIS-FVNASD-LNVANNNLSYWDAP 484
SEQIDNO:38   LKLND-GNRTLIDFTFIV-NASASVQKFYLREVNVTLLNYQNGSVILSADNNNLSKWDAS 338
SEQIDNO:39   LKLND-GNSTLIGFTFAVKNTSASVQKFYLREVNVTLLNRLGSVISSADNSNLSKWDAF 469
SEQIDNO:40   LILTD--NSTVIEFTLALKNK----NHFYLKEVNVALI---NGSASSTRQNQNLSAWEAS 322
SEQIDNO:41   -DLILTS--DTITIMFTFSNDG---KKFHLALKVTVK-PATG-DPVIAVNNNMSIWAAA 318
SEQIDNO:42   LVLTQ-TQSTILTFNFTLNSTT---NKYHLSGVTLIAN-WFDS-AHFSMSNNSLNYLRST 324
SEQIDNO:43   LTLTTDAEKTNLTFVALNTTS---NKYHLSEVSLSAA-LSDMKETFVAQNHSLDYLRGT 163
                  *         : . :  . .      ::: *  :.:          * .:.   .
```

LAMP HOMOLOGY DOMAIN 2                                    Trans. Domain
                                3                           4

```
SEQIDNO:2    LGSSYMCNKEQTVSVSGAFQINTFDLRVQPFNVTQGKYSTAQDCSADD-DNFLVPIAVGA 383
SEQIDNO:25   LGSSYMCNKEQVLSVSRAFQINTFNLKVQPFNVTKGQYSTAQECSLDDD-TILIPIIVGA 388
SEQIDNO:26   VDSSYMCHKEQQIKVSEDLFINAFDVRVQPFGVNNGTFATAEDCFAD-Q-NFIVPIVVGA 387
SEQIDNO:27   VGSSYMCRKEQSYNISDKLTLNTFELQVQPFDVKKNSFSTAHECSLDDT-SLLIPIIVGA 328
SEQIDNO:28   LGSSYMCNKEQTVSVSGAFQINTFDLRVQPFNVTQGKYSTAEECSADSDLNFLIPVAVGV 384
SEQIDNO:29   LGSSYMCNKEQTVSVSGAFQINTFDLRVQPFNVTQGKYSTAQDCSADD-DNFLVPIAVGA 383
SEQIDNO:30   LGSSYMCNKEQTVSVSGAFQINTFDLRVQPFNVTQGKYSTAEECSADSDLNFLIPVAVGV 337
SEQIDNO:31   LGSSYMCNKEQTVSVSGAFQINTFDLRVQPFNMEGKYSTAQECSLDDD-TILIPIIVGA 384
SEQIDNO:32   LGSSYMCNKEQTVSVSGEFQINTFDLRVQPFNVKDGKYSTAQDCRADD-DNFLVPIAVGA 390
SEQIDNO:33   LGSSYMCNKEQTVSVSGAFQINTFDLRVQPFSVTEGKYSTAQECSLDDD-TILIPIIVGA 380
SEQIDNO:34   LGSSYMCNKEQTVSVSGAFQINTFNLRVQPFSVMEGKYSTAQDCSADD-DNFIVPIAVGA 384
SEQIDNO:35   LGSSYMCNKEQTVSVSGALQINTFDLRVQPFSVTEGKYSTAEECSADSDLNFLIPVAVGV 381
SEQIDNO:36   LGSSYMCNKEQVVSVSRTFQINTFNLKVQPFNVTKGEYSTAQDCSADED-NFLVPIAVGA 384
SEQIDNO:37   LGSSYMCNKEQTLALADSLQINTFNLRVQPFSVVAGKYSTAEDCSADDD-NFIVPIAVGA 543
SEQIDNO:38   LGNSYMCRKEQTLEINENLQVHTFNLWVQPFLVKENKFSIAEECFADSDLNFLIPVAVGM 398
SEQIDNO:39   LGSSYMCRKEQTLQINENVQVHTFNLWIQPFLVEANKFATAEECIADSDLNFLIPIAVGV 529
SEQIDNO:40   VGSSYMCHKEQQIKVSEDLVINSFDVRVQLFGVKNETFATAQQCSLDDD-SIVIPIVVGA 381
SEQIDNO:41   VGSSYMCNKEQTLNVTDTLTLYTFELRVQPFEVNKGEFATAHECSLDDT-SILIPIIVGA 377
SEQIDNO:42   LGYSYMCNAEQTLFVTPSFSLNTFDLQVQPFGVKSGRFATAEECQMDQN-QMIIPIIVGA 383
SEQIDNO:43   LGFSYMCRERQTLGVTPDFAINTFQVQVQPFGVTGKQFAAAEECQLDKD-DMLIPIIVGA 222
             :. ****,.*    :    . : :*:: :* *  *    :: *.:*  *    :::*: **
```

FIG. 4 (cont.)

```
                  Cytoplasmic Tail

SEQIDNO:2    ALAGVLILVLLAYFIGLKHHH-AGYEQF   410
SEQIDNO:25   GLSGLIIVIVIAYLIGRRKTY-AGYQTL   415
SEQIDNO:26   ALGVLVVLVMVAYFIGRRKQSSAGYEQM   415
SEQIDNO:27   ALAGLIFIVVIAYVIGRRRTY-VGYQTL   355
SEQIDNO:28   ALGFLIIVVFISYMIGRRKSR-TGYQSV   411
SEQIDNO:29   ALAGVLILVLLAYFIGLKRHH-AGYEQF   410
SEQIDNO:30   ALGFLIIVVFISYMIGRRKSR-TGYQSV   364
SEQIDNO:31   GLSGLIIVIVIAYLIGRRKSY-AGYQTL   411
SEQIDNO:32   ALAGVLILVLLAYFIGLKRHH-AGYEQF   417
SEQIDNO:33   GLSGLIIVIVIAYLIGRRKSY-AGYQTL   407
SEQIDNO:34   ALAGVLILVLLAYFIGLKRHH-AGYEQF   411
SEQIDNO:35   ALGFLIIVVFISYMIGRRKSR-TGYQSV   408
SEQIDNO:36   ALGGVLILVLLAYFIGLKRHH-TGYEQF   411
SEQIDNO:37   ALGGLVILVLMAYFVGRKRRA-TGYEQF   570
SEQIDNO:38   ALGFLIILVFISYIIGRRKSR-TGYQSV   425
SEQIDNO:39   ALGFLIILVFISYIIGRRKSR-TGYQSV   556
SEQIDNO:40   ALAGLIVIIVIAYLIGRRKGY-SGYQTL   408
SEQIDNO:41   ALAGLILIVVIAYVIGRRKTY-VGYQTL   404
SEQIDNO:42   ALAGLVLITLIAYLIGKRRSH-AGYQAI   410
SEQIDNO:43   ALAALVLIVLSAYLIGRKRSH-AGYQSI   249
             .*. ::.:   .:*.:*  ::    **: .
```

| | LAMP-2 | | | | |
|---|---|---|---|---|---|
| Accession No. | Species | SEQ ID NO: | Accession No. | Species | SEQ ID NO: |
| NP_002285.1 | H. sapiens | 2 | NP_001231184.1 | S. scrofa | 34 |
| NP_034815.2 | M. musculus | 25 | XP_004022401.1 | O. aries | 35 |
| NP_001087881.1 | X. laevis | 26 | NP_058764.2 | R. norvegicus | 36 |
| NP_001013551.1 | D. rerio | 27 | XP_001510101.2 | O. anatinus | 37 |
| XP_003918270.1 | P. Anubis | 28 | NP_001001749.1 | G. gallus | 38 |
| XP_003918270.1 | M. mulatta | 29 | XP_002191794.1 | T. guttata | 39 |
| XP_003317709.1 | P. troglodytes | 30 | NP_001116192.2 | X. tropicalis | 40 |
| XP_005641822.1 | C. lupus familiaris | 31 | NP_001133282.1 | S. salar | 41 |
| XP_001493687.3 | E. caballus | 32 | XP_003445830.1 | O. niloticus | 42 |
| NP_001029742.1 | B. Taurus | 33 | XP_003961835.1 | T. rubripes | 43 |

FIG. 4 (cont.)

HUMAN LAMP-3 ALIGNMENT WITH ORTHOLOGOUS SEQUENCES

SIGNAL SEQUENCE / LAMP HOMOLOGY DOMAIN 1

```
SEQIDNO:3   MPRQLSAAAALFASLAVILHD----GSQMRAKAFPETRDYSQPTAAATVQDIKKPV-QQP 55
SEQIDNO:44  MPRQLSAAAALFASLAVILHD----GSQMRAKAFPETRDYSQPSAAATVQDIKKPV-QQP 55
SEQIDNO:45  MPRQLSAAAVLFASLAVILHD----GSQMRAKAFPKTRDYSQPTAAATGQDIAKPV-QQP 55
SEQIDNO:46  MPRQLSAAAVLFASLAVILHD----GSQMRAKAFPKTRDYSQPTAAATGQDIAKPV-QQP 55
SEQIDNO:47  MSWQLSAAVALFVSLALILHY----GSQIRAKMFPETVDFQ-PTTAATVRATAKPFL-HL 54
SEQIDNO:48  MSWRLSAVLVSFVSLAVFLHY----GHHMKAKVFPEITDSSSPTTAATVQATAEPSLWKP 56
SEQIDNO:49  ------------------------------------------------------------ 0
SEQIDNO:50  MAWQLSAVVVLFVSLAVILYY----GSHVRANVFPEITDYSQPTTAATIQTRAQPSLSQP 56
SEQIDNO:51  MSWQIPAVVMSFMALVAIWYYDSHYNSHMQAKVFPEITGYSSPTTG---QATVKPSLLQP 57
SEQIDNO:52  MSWQISAVVLFFVSLAVIWYYDS----HMKANVFPEITGYSSPTTG---QATVKPSLLQP 53
SEQIDNO:53  MPGQTSAVAVL-LCLAVILH-----GYQIREKEFPEARGYLQYTATTTEQITAKPPL-PL 53
SEQIDNO:54  MPGQISAVAVLFLSLTVILH-----GYQIREKEFPKARGYLQYTATSAEQITTKPLL-QL 54
SEQIDNO:55  ------------------------------------------------------------ 0
```

LAMP HOMOLOGY DOMAIN 1

```
SEQIDNO:3   AKQAPHQTLAARFMDGHITFQTAATVKIP--------------TTTPATTKNTATTSPITY 102
SEQIDNO:44  AKQAPHQTLAARFMDGHITFQTAATVKTP--------------TTTPATTKNTATTSPITY 102
SEQIDNO:45  ANQAPHQTLAARLMDGHITFQTAATIKTP--------------TTTPVTTKNTPTTSPIIY 102
SEQIDNO:46  ANQAPHQTLAARLMDGHITFQTAATIKTP--------------TTTPVTTKNTPTTSPIIY 102
SEQIDNO:47  TNQVPSQTLAARSMDGHIASQRAATTSSSEPPTTHTTVKTLVTTSLVTANSTPSSSPIIY 114
SEQIDNO:48  TNHTPHKTLAAKSTDGHVTSQIATTVTDSETLTTHTTITTLAATSLAATNSTPSTSPTTH 116
SEQIDNO:49  ------------------------------------------------------------ 0
SEQIDNO:50  TNQVPHKTLATRSMDGQVTSQTAATTVNPETPVTHTTIKTAAATSLVTTNSTLSTSPITN 116
SEQIDNO:51  TNYVPHKTAAARSTDGHVTSQTVAKTSSSETLTTNTTIDVLATTSPVTTKSTLPTTPTTH 117
SEQIDNO:52  TNHVPCNTAAAKSTDGHVTSQTVAKTSSPETLTTNTTIEVLVTTSPVTTQSTLPTTPTTH 113
SEQIDNO:53  TNQTSHATLASRSKDDYIQTAAETS--TFE----DTAHITMKTAIPVTTKSLLPISSTSY 107
SEQIDNO:54  INQRSHITLASRFKDDYIQMAAETS--AIE----NTAHITMKTVTPVTTKSLPPISSASY 108
SEQIDNO:55  ---------------------------------------------MDRVSLLSTILLLY 14
```

LAMP HOMOLOGY DOMAIN 1

```
SEQIDNO:3   TLVT--------TQATPNNSHTAPPVTEVTVGPSLAPYSLPPTI--TPPAHTTGTSSSTV 152
SEQIDNO:44  TLVT--------TQATPNNSHTAPPVTEVTVGPSLVPYSLPPTI--TPPAHTTGTSSSTV 152
SEQIDNO:45  TLVT--------TQATSNNSHTAPPLTKVTVGPSLAPYSLPPTI--TPPAHTTGTSSSTV 152
SEQIDNO:46  TLVT--------TQATSNNSHTAPPLTKVTVGPSLAPYSLPPTI--TPPAHTTGTSSSTV 152
SEQIDNO:47  TLVT--------TIVTPNNSNTAAPVTEATIGPSADGSLPTTS--TPLAHTTRTNPSTL 164
SEQIDNO:48  TLFT--------TLATPNTSHMAAPVTEAAISPSAGLSSLLPTI--IPPAHTTGTRSSTL 166
SEQIDNO:49  ------------------------------------------------------------ 0
SEQIDNO:50  TLLT--------TLATPDNTHTTPVTEATIGPSAGPGSPPTTITTTSSAYTTGTRSSTV 168
SEQIDNO:51  TLVT--------TLATPNKSHVTFPVTEAKVGLSVGPSSPPVTV--NPTAHTTGNRPSTA 167
SEQIDNO:52  TLVT--------TLATPSKSHVTFPVTEAKAGLSIGPSSPPVTI--NPAAHTTGNRPSTA 163
SEQIDNO:53  TFV-----------RTNNSHMTASSTEDTIGSGSITHL---------PFPTTRASLAAV 146
SEQIDNO:54  TFV-----------RSNNAHMTASSTDDTIGSGSIAHL---------PVPTTRASLAIV 147
SEQIDNO:55  GLLYINDAYSENTFAQPSNTTTPAPNTTTTHVTSNTTTLAP----------------NTTT 59
```

FIG. 5

LAMP HOMOLOGY DOMAIN 1

```
SEQIDNO:3   SHTTGNTTQPSNQTTLPATLSIALHKSTTGQKPVQP---THAPGTTAAAHNTTRTAAPAS 209
SEQIDNO:44  SHTTGNTTQPSNQTTLPATLSIALHKSTTGQKPVQP---THAPGTTAAAHNTTRTAAPAS 209
SEQIDNO:45  NHTTGNATQPSNQTTLPATLSIALHKSTTGQKPVQP---THAPGTTAAAHNTTRTAAPAS 209
SEQIDNO:46  NHTTGNATQPSNQTTLPATLSIAPHKSTTGQKPVQP---THAPGTTAAAHNTTRTAAPAS 209
SEQIDNO:47  SHKTRKTTHFGNQTTLPATLSTSTHKSTSSHKSAQS---THAPGPTTAAHNTTQTASPAT 221
SEQIDNO:48  SPTAGKTTQPSNQTTLPATLSTSPHNSTASQKPTHP---NHTPGPTTGAHNTTQTASPAT 223
SEQIDNO:49  ------MTQSSRSVLLLMLSSLHCLGSSLESNPKDPSVLAEAPGQN------KRDSDISL 48
SEQIDNO:50  SHTTGKTTQLSNQTTLPATLSTSPHNSTTSQNPAHS---THTPGPTTGTCNTTQTASPTT 225
SEQIDNO:51  SHTTGKTTQLSNQTTLPATLSTSPHNITTSQKPTQP---THTPGPTTATYNTTQTASPAT 224
SEQIDNO:52  SHTTGKTTQLSNQTTLPATLSTSPHNITTSQKPTQP---THTPGPTTAANNTTHTASPAT 220
SEQIDNO:53  NHITGRSTQLGGQTTLPKALFTPSHESTTTQRPTLS---TI-VSELTPTGKDRSTTSSVP 202
SEQIDNO:54  NYITGRATQLGGQTTLPKTFFTASHKSTTNQRPTLS---TNVLGTSTPTHKDRSTTSPVP 204
SEQIDNO:55  THVTSNTTTLA------PNTTTTHITSNTTTLAPNTT---TTLAPNTTTHSVTTTKTAST 111
                    *  .                   :
```

Hinge        LAMP HOMOLOGY DOMAIN 2
1

```
SEQIDNO:3   TVPGPTLAPQPSSVKTGIYQVLN-GSRLCIKAEMGIQLIVQDKESVFSPRRYFNIDPNAT 268
SEQIDNO:44  TVPGPTLAPQPSSVKTGIYQVLN-GSRLCIKAEMGIQLIVQDKESVSWGHRTITLSS--K 266
SEQIDNO:45  TVPGSTLAPQPSSVKTGIYQVLN-GSRLCIKAEMGIQLIVQDKESVFSPRRYFNLDPNAT 268
SEQIDNO:46  TVPGSTLAPQPSSIKTGIYQVLN-GSRLCIKAEMGIQLIVQDKESVFSPRRYFNLDPNAT 268
SEQIDNO:47  PASGPTLAPQPSSPKTGIYQVLN-GSRLCIKAEMGIELMVQDTKSVFSPQRYFNIDPNAT 280
SEQIDNO:48  IAPGPTLAPQPSSAKTGIYQVLN-GSKLCIKAEMGIELTVQDTQSVFSPQRYFNIDPNTT 282
SEQIDNO:49  VPQMPVLQPKETAPPLVTYTIRNPQGKVCVRASFGVEFVVREN----KKKYYFNLTPNSA 104
SEQIDNO:50  TAPGPTLAPQPSSAKTGMYQILN-GSKLCIKAEMGIQLTVQDTKSASPPQGYFNIDPNTT 284
SEQIDNO:51  IAPRPTLAPQPLSPKTGIYQVHN-GSKLCIKAEMGIQLTVQDSVSVFSPQKYFNIDPNAT 283
SEQIDNO:52  IAPRPTLAPQPLSPKTGLYQVLN-GSKLCIKAEMGIQLTVQDSVSVFSPQKYFNIDPNAT 279
SEQIDNO:53  LVPRPTFVTWSSPAKIGTYEVLN-GSRLCIKAEMGIALIVQEKGLDSATQRHFNIDPSLT 261
SEQIDNO:54  LVPRPTLVTWSSPAKIGTYEVLN-GSRLCIKAEMGLALIVQEKDLDSATQRYFNIDPSLT 263
SEQIDNO:55  TTPTPTLEPKPSPPETGNYTVKI-KNEFCIEALMGLELELTNS---TKTQQYFNIVPSQI 167
             .:        *  :   ...*:.* :*:   :  :.           :  :.:
```

LAMP HOMOLOGY DOMAIN 2
2

```
SEQIDNO:3   QASGNCGTRK----SNLLLNFQGGFVNLTFTKDEESYYISEVGAYLTVS-----DPETIY 319
SEQIDNO:44  SLSGGCLARNEHSPHPLFLFFEKGPPSVTQAEDEESYYISEVGAYLTVS-----DPETIY 321
SEQIDNO:45  QASGNCGTRN----SNLLLNFQGGFVNLTFTKDEGSYYISEVGACLTVS-----DPETIY 319
SEQIDNO:46  QASGNCGTRN----SNLLLNFQGGFVNLTFTKDEGSYYISEVGACLTVS-----DPETIY 319
SEQIDNO:47  QTSGNCGSQK----SNLLLNFQGGFVNLTFLKDENSYYINEVGAYLAVS-----NPEKIY 331
SEQIDNO:48  QASGNCGSRK----SKLLLNFQGGFVNLTFTKDENSYYVSGVGAYLTVS-----NPEKVY 333
SEQIDNO:49  RATGYCANQK----TVLSLEFSGGNLEFTFIKDGDQSYVKTVKGSLRAAPPCKNCPSKIY 160
SEQIDNO:50  QVSGICGSRK----SNLLLNFWGGFVNLTFTKDENSYYISEVGAYLTVS-----NPEKTY 335
SEQIDNO:51  QASGNCGSRK----SNLLLNFQGGFVNLTFTKGEKSYYISEVEAYLTVS-----NPAKVY 334
SEQIDNO:52  QASGNCGSRK----SNLLLNFQGGFVNLTFIKDENSYYISEVEAYLTVS-----NPAKVY 330
SEQIDNO:53  HASGKCGSQN----SNLFLNFQGGSVNVTFTKEENLYYVSEVGAYLTIS-----NTEKTY 312
SEQIDNO:54  HASGKCDSQK----SNLFLNFQGGSVNITFTKEENLYYISEVGAYLTIS-----NTEKTY 314
SEQIDNO:55  NSNGTCEKSK----ANLNLTFANSYINFVFAQDDNSYYLDNVTVYFNLT-----RSESWY 218
             .* *  :      *  *   . ...  :     *:.*  :  :        .  *
```

FIG. 5 (cont.)

LAMP HOMOLOGY DOMAIN 2
```
                                     3                              4
SEQIDNO:3   QGIKHAVVMFQTAVGHSFKCVSEQSLQLSAHLQVKTTDVQLQAFDFEDDHFGNVDECSSD 379
SEQIDNO:44  QGIKHAVVMFQTAVGHSFKCVSEQSLQLSAHLQLKTTDVQLQAFDFEDDHFGNVDECSSD 381
SEQIDNO:45  QGMKHAVVMFQTAVGHSFKCVSEQSLQLSAHLQLKTTNVQLQAFDFEDDHFGNVDECSSD 379
SEQIDNO:46  QGMKHAVVMFQTVVGHSFKCVSEQSLQLSAHLQLKTTNVQLQAFDFEDDHFGNVDECSSD 379
SEQIDNO:47  QGMKSSVVMFETGVGHSFKCVSEQSIQLSTHLQLKTMNVQFQAFDFEDDHFGNVDECSSD 391
SEQIDNO:48  QGMKNAVVMFETMIGHSFKCVSEQSIQLSPHLQLNTMNVQLQAFDFEDDHFGNVDECSSD 393
SEQIDNO:49  VGLVDNEKLFKAKNGLSFNCKSETMLILADYFRLKLVPLQIQAFDLVNGAFGKEVECWAD 220
SEQIDNO:50  QGMKSPVVMFETVIGHSFKCVSEQSLELSTQLHLKTTNVQLQAFDFEDDNFGNVDECSSD 395
SEQIDNO:51  QGLKHAMMMFETVVGHSFKCVSEQSIQLSTYLQLKTMNVQLQAFDFEDDHFGNADECISD 394
SEQIDNO:52  QGMKYAMMMFETVVGHSFKCVSEQSIQLSNHLQLKTVNVQLQAFDFEDDRFGNADECISD 390
SEQIDNO:53  QGKS-TMMMFETVVGHSFKCVSEQSIQLSAQLQMKTMNIHLQAFDFEGDSFGIVDECLSD 371
SEQIDNO:54  QGKKNTLMMFETVVGHSFKCVSEQSIQLSAQLQMKTMNIHLQAFDFEGDSFGNVECLSD  374
SEQIDNO:55  GNAT-NQKLLKTENGYSVKCKNTPKIQLGDTMNLVMTNVKLQVFNFKDNSFGKETTCKYD 277
            .    ::::  * *.:* .    : *.  :.:   :::*.*::  .. **    *  *

Trns Memb.     Cyto. Tail

SEQIDNO:3   YTIV-LPV-IGAIVVGLCLMGMGVYKIRLRCQSSGYQRI   416
SEQIDNO:44  YTIV-LPV-IGAIVVGLCLMGMGVYKIRLRCQSSGYQRI   418
SEQIDNO:45  YTIV-LPV-IGAIVVGLCLVGIGVYKIRLRCQSSGYQRI   416
SEQIDNO:46  YTIV-LPV-IGAIVVGLCLVGMGVYKIRLRCQSSGYQRI   416
SEQIDNO:47  YTVV-LPV-IGAIVLGLCAVGLIVYGIHLRRESSGYQRI   428
SEQIDNO:48  YTIV-LPV-IGAIVLGLCAVGLIVYGIRLKRESSEYQRI   430
SEQIDNO:49  YNKRMIPIILGAVAAAICLIAILTYVLVREHRNQGYEQL   259
SEQIDNO:50  YTVV-LPV-IGAIVLGLFAVGLIVYGVRVRREASGYQRI   432
SEQIDNO:51  RNRREIPVAVGLSIAVLLAVLLTACLVTRKRPSRGYERM   433
SEQIDNO:52  RNRREIPVAVGLSIAVLLAVLLTACLVTRKRPSRGYERM   429
SEQIDNO:53  YTVV-LPV-VGIIVVVLCVVGLGIYKIRQRRQSSAYQRI   408
SEQIDNO:54  YTVV-LPM-VAIIVVVICVVGLSVYKIRQRHQSSAYQRI   411
SEQIDNO:55  HNFG-LMI-AGIVIVVIVVLGVIIYFIWHKRKSSGYQRI   314
             .  :  .     : : :     :  .      *:::
```

| | LAMP-3 | | | | |
|---|---|---|---|---|---|
| Accession No. | *Species* | SEQ ID NO: | Accession No. | *Species* | SEQ ID NO: |
| NP_055213.2 | *H. sapiens* | 3 | XP_001496333.1 | *E. caballus* | 50 |
| XP_001155195.3 | *P. troglodytes* | 44 | NP_001095605.1 | *B. Taurus* | 51 |
| XP_003894825.1 | *P. Anubis* | 45 | XP_004003158.1 | *O. aries* | 52 |
| NP_001028044.1 | *M. mulatta* | 46 | NP_001012015.1 | *R. norvegicus* | 53 |
| XP_848889.2 | *C. lupus familiaris* | 47 | NP_796330.2 | *M. musculus* | 54 |
| XP_003358746.1 | *S. scrofa* | 48 | XP_002936919.2 | *X. tropicalis* | 55 |
| XP_001342688.2 | *D. rerio* | 49 | | | |

FIG. 5 (cont.)

HUMAN LIMP-2 ALIGNMENT WITH ORTHOLOGOUS SEQUENCES

```
                                                                    SIGNAL SEQUENCE
SEQIDNO:4   ----------------------------------------------MGRCCFYTAGTLS  13
SEQIDNO:56  ----------------------------------------------MGRCCFYTAGTLS  13
SEQIDNO:57  ----------------------------------------------MGRCCFYTAGTLS  13
SEQIDNO:58  ----------------------------------------------MGRCCFYTVGTLS  13
SEQIDNO:59  ----------------------------------------------MGRCCFYAVGTLS  13
SEQIDNO:60  ----------------------------------------------MGRCCFYTAGTLS  13
SEQIDNO:61  ----------------------------------------------MTRRSCTIYATGIVC 15
SEQIDNO:62  ----------------------------------------------MARCCFYTAGTLS  13
SEQIDNO:63  ----------------------------------------------MRSLCLVTVGVLA  13
SEQIDNO:64  ----------------------------------------------MVKWAVFGTAAVS  13
SEQIDNO:65  MQLDDILHINNCKADCSSLSTTPNPKTDLVNMNGPKHKFCTKLSSTYLRKWWITIV--VA  58
SEQIDNO:66  ------------------------------------MYGRSNRLCAKLSSAFLRKWWFVIA--FA  27
                                                             .   . ..

LAMP HOMOLOGY DOMAIN
SEQIDNO:4   LLLLVTSVTLLVARVFQKAVDQSIEKKIVLRNGTEAFDSWEKPPLPVYTQFYFFNVTNPE  73
SEQIDNO:56  LLLLVTSVTLLVARVFQKAVDQSIEKKIVLRNGTEAFDSWEKPPLPVYTQFYFFNVTNPE  73
SEQIDNO:57  LLLLVTSVTLLVARVFQKAVDQSIEKKIVLRNGTEAFDSWEKPPLPVYTQFYFFNVTNPE  73
SEQIDNO:58  LLLLVTSIALLVARVFQKAVDQTIEKNIVLRNGSETFDSWKKPPLPVYAQFYFFNVTNPE  73
SEQIDNO:59  LLLLVTSITLLVARVFQKAVDQTIEKNIVLRNGSETFDSWKKPPLPVYTQFYFFNVTNPE  73
SEQIDNO:60  LLLLVTSVTLLVARVFQKAVDQTIEKNMVLQNGTKVFNSWEKPPLPVYIQFYFFNVTNPE  73
SEQIDNO:61  AHLLILGIALLLAQVFQTMIQERIKKEITLAENSRVLDGWINPPPPVYMQYFFFNVTNPD  75
SEQIDNO:62  LLLLVTSVTLLVARVFQKAVDQTIEKNMVLQNGTKVFDSWEKPPLPVYIQFYFFNVTNPE  73
SEQIDNO:63  LTLLIASISLLVAHVFQTVVDLQVKQGTVLKNGTETFEAWEDPPPPVYMQFYFFNVTNPL  73
SEQIDNO:64  VTLLIVSIVLLLTHTFMDIVEGQVKQAIVLKNESEVFEDWANPPPPVYMQFYFFNVTNPL  73
SEQIDNO:65  AALIIG--GIVVACEFTVLIDAVVDRMVALRPGAKTFGWWAKPPVEPRISLYIYNVTNAD 116
SEQIDNO:66  LSLLVL-GALVTFGFTAFIRTIIDHQVALRVGGQSFGWWSRPPVEPIIRIFVYNVTNAD  85
             *::        :::  *    :   :.: .*    . :  *  **     :.:****

LAMP HOMOLOGY DOMAIN
SEQIDNO:4   EILRGE-TPRVEEVGPYTYRELRNKANIQFGDNGTTISAVSNKAYVFERDQSVGDPKIDL 132
SEQIDNO:56  EILRGE-TPRVEEVGPYTYRELRNKANIQFGDNGTTISAVSNKAYVFERDQSVGDPKIDL 132
SEQIDNO:57  EILRGE-TPRVEEVGPYTYRELRNKANVQFGDNGTTISAVSNKAYVFERDQSVGDPKIDL 132
SEQIDNO:58  EILRGE-IPRLEEVGPYTYRELRDKADIQFGDNGTTISAVSNKAYVFERNQSVGDPKTDL 132
SEQIDNO:59  EILNGE-TPRLEEVGPYTYRELRNKDDIQFGDNGTTISAVSNKAYVFERDKSVGDPKIDL 132
SEQIDNO:60  EILQGE-IPLLEEVGPYTYRELRNKANIQFGENGTTISAVTNKAYVFERNQSVGDPNVDL 132
SEQIDNO:61  EFLAGKEKAKVTQMGPYTYREYRPRENVTYLENGTKIFATNPKSFVFLRNMSAGDPEVDR 135
SEQIDNO:62  EILQGE-IPLLEEVGPYTYRELRNKANVQFGENGTTISAVTNKAYIFERNQSVGDPTVDL 132
SEQIDNO:63  EVLQGA-TPLVEEKGPYTYREYRPRVHVQFLDNGTKVSALNPKTYVFEPEKSVGNPEVDL 132
SEQIDNO:64  EVLSGE-KPFVDEIGPYTYREYRPRENITFSVNGTEVSAVTPKTYVFEPEKSIGDPKVDL 132
SEQIDNO:65  DFLSNGSKAIVDEVGPYVYSETWEKVNIVENDNGTL-SYNLRKIYSFREDLSVG-PEDDV 174
SEQIDNO:66  EFLNNGTKPILDELGPYVYQTWEKVNIKENPNGTI-SYNQKRVYIFNEDLSGG-LEDDV 143
             :.* .    : : ***.*  :    .:    ***     : : *  :  *      *
```

FIG. 6

LAMP HOMOLOGY DOMAIN

```
SEQIDNO:4   IRTLNIPVLTVIEWSQ-V-HFLREIIEAMLKAYQQKLFVTHTVDELLWGYKDEILSLIHV 190
SEQIDNO:56  IRTLNIPVLTVIEWSQ-V-RFLREIIEAMLKAYQQKLFVTHTVDELLWGYKDEILSLIHV 190
SEQIDNO:57  IRTLNIPVLTVIEWSQ-V-HFLREIIEAMLKAYQQKLFVTHTVDELLWGYKDEILSLIHV 190
SEQIDNO:58  IRTLNIPAVTAMEWAH-L-HFFRELIEALLKAYQQTLFVTHTVDELLWGYKDEILSLINV 190
SEQIDNO:59  LRTLNIPALTAMEWTQ-L-PLLRDIIEALLKAYRQKLFVTHTVDELLWGYKDEILSLINT 190
SEQIDNO:60  IRTINIPLLTVVDLAQ-L-TLLRELIEAMLKAYQQKLFVIHTVHELLWGYKDEILSLVHI 190
SEQIDNO:61  VTTVNIPMIAVMNELNSYSFFVRTAVSMYMGSMGMGLFMNRTVHEILWGFKDPLLTKLHA 195
SEQIDNO:62  IRTINIPLLTVVEMAQ-Q-PFLREIIEAMLKAYQQTLFVTHTVHELLWGYKDEVLSLVHI 190
SEQIDNO:63  IRTINVPAVTAMEWTR-A-TSLQFATEVLLLLYQESLFTVRTVHELLWGYKDKLLSTIHV 190
SEQIDNO:64  IRTVNIPLVTILEMTK-DSSLLRPFIIAALKTYKEGMFVTRTVDELLWGYKDAVLSILHP 191
SEQIDNO:65  VIVPNIPMLSATSQSKHAARFLRLAMASIMDILKIKPFVQVSVGQLLWGYEDPLLKLAKD 234
SEQIDNO:66  VIVPNIPMLSATSQSKHAARFLRLAMASIMDILKIKPFVEVSVGQLLWGYEDPLLKLAKD 203
            :  *:* ::  .  ,   .:       :       *   :*  ::***::* :*.  :
```

LAMP HOMOLOGY DOMAIN
1

```
SEQIDNO:4   FRPDI----SPYFGLFYEKNGTNDGDYVFLTGEDSYLNFTKIVEWNGKTSLDWWITDKCN 246
SEQIDNO:56  FRPDI----SPYFGLFYEKNGTNDGDYVFLTGEDSYLNFTKIVEWNGKTSLDWWITDKCN 246
SEQIDNO:57  FRPDI----SPYFGLFYEKNGTNDGDYVFLTGEDNYLNFTKIVEWNGKTSLDWWITDKCN 246
SEQIDNO:58  FKPEI----SPYFGLYYGKNGTNDGDYVFLTGEDNYLNFSKIVEWNGKTSLDWWTTDKCN 246
SEQIDNO:59  FKHDV----SPYFGLFYGKNGTNDGDYVFLTGEDNYLNFSKIVEWNGKTSLDWWTADECN 246
SEQIDNO:60  FKPDV----SPNFGLFYERNGTNDGEYVFLTGEDNYLNFSKIVEWNGKTSLDWWTTDTCN 246
SEQIDNO:61  MRPEV----DEHFGLMYNKNGTHEGEFVFHTGEKNYMNYGKIDTWNGISQMNWWSSNQSN 251
SEQIDNO:62  FRPDV----SPNFGLFYERNGTNDGEYVFLTGEDNYLNFTKIVEWNGKTSLDWWTTDTCN 246
SEQIDNO:63  LHPEI----DPVFGFFNKMNGTDDGEYVFLSGEMNYLNFSRIVEWKGKESLNWWTTKTCN 246
SEQIDNO:64  FKKNI----SDTFGLFYKMNTTDDGEYIFLSGEKDYLEFTQIAEWKGQKALNWWTTETCN 247
SEQIDNO:65  VVPKEQKLPYEEFGLLYGKNGTSSDRVTVNTGVDDIRRYGIIDNFNGRTHLPHWTTDACN 294
SEQIDNO:66  VVPKEQKLPYEEFGLMYGKNSTSKDTVTVWTGVDDITQYGIIDKYNGRSHQTHWLSEQCN 263
            .  .        **:    * *  ..  .:*  . .:  *  ::*        *  :..*
```

LAMP HOMOLOGY DOMAIN
2

```
SEQIDNO:4   MINGTDGDSFHPLITKDEVLYVFPSDFCRSVYITFSDYES-VQGLPAFRYKVPAEILANT 305
SEQIDNO:56  MINGTDGDSFHPLITKDEVLYVFPSDFCRSVYITFSDYES-VQGLPAFRYKVPAEILANT 305
SEQIDNO:57  MINGTDGDSFHPLITKDEVLYVFPSDFCRSVYITFSDYES-VQGLPAFRYKVPAEILANT 305
SEQIDNO:58  MINGTDGDSFHPLIDKDEILYVFPSEFCRSVYITFSDFKS-VQGLPAFRYKVPGEVLANT 305
SEQIDNO:59  MINGTDGDTFHPLITRDEVLYVFPSDFCRSVYITFSDFES-VQGLPALRYKVPAEILANT 305
SEQIDNO:60  MINGTDGDSFHPLISKDEVLYLFPSDLCRSVHITFSSFEN-VEGLPAFRYKVPAEILANT 305
SEQIDNO:61  MINGTDGSVFHTFLSRKELLYIFAADLCRSIHLGYVRDME-VKGIPAFRFAPPSDVLAPP 310
SEQIDNO:62  MINGTDGDSFHPLISKDETLYIFPSDFCRSVYITFSSFEN-VEGLPAFRYKVPAEILANS 305
SEQIDNO:63  MINGTDGTSFHPLISKDENIYIFSSDFCRSLYLVYDSSGS-VAGVPTYRFVPSPMVFANT 305
SEQIDNO:64  MINGTDGTSFHPLLNKDDTIYMFSSDLCRSIYAVYESSEN-IKDISVFRFSPPASVFANV 306
SEQIDNO:65  TLAGTDGSIFPPHIDHDRILHVYDKDLCRLLPLVFEKEVMTSNEVPGYRFTPPEWVFADV 354
SEQIDNO:66  RLNGTDGSIFPPRITKNSTLHVYEKDLCRLLPLSFEKEVTRGGVKGYRFTPSPDVFASV 323
            : ****  *    :. :::: ::**  :    :      : *:    ::*
```

FIG. 6 (cont.)

LAMP HOMOLOGY DOMAIN

```
                         3         4          5
SEQIDNO:4    ---SDNAGFCIPE-GNCLGSGVLNVSICKNGAPIIMSFPHFYQADERFVSAIEGMHP-NQ 360
SEQIDNO:56   ---SDNAGFCIPE-GNCLGSGVLNVSICKNGAPIIMSFPHFYQADERFVSAIEGMHP-NK 360
SEQIDNO:57   ---SDNAGFCIPE-GNCLGSGVLNVSICKNGAPIIMSFPHFYQADERFVSAIEGMHP-NK 360
SEQIDNO:58   ---SDNAGFCVPK-GNCLGSGVLNISICKNGAPIIISFPHFYEADKKFVSAIDGMRP-NK 360
SEQIDNO:59   ---SDNAGFCIPK-GNCLGSGVLNVSVCKNGAPIIMSFPHFYQADEKFVSAIGGMHP-NK 360
SEQIDNO:60   ---SENAGFCIPE-GNCMDSGVLNISICKNGAPIIMSFPHFYQADEKFVSAIKGMHP-NK 360
SEQIDNO:61   DENPANAGFCVPA-GDCLGKGVLKVSVCRQGAPIVVSFPHFYQADERYINAIEGMNP-NE 368
SEQIDNO:62   ---SENAGFCIPE-GNCMDAGVLNVSICKNGAPIIMSFPHFYQADEKFVSAIKGMRP-NK 360
SEQIDNO:63   TVNPDNAGFCVPP-GNCPGAGVLNVSICKQGAPIFLSAPHFYQADQKFVSDIEGMHP-TK 363
SEQIDNO:64   SVNPQNKGFCVPE-GNCLPSGLLNVSICKEGAPIVLSSPHFYQADENVINSIRGMKP-VK 364
SEQIDNO:65   DSHPDNMCFCPAGKPSCSPNGLFNVSLCYDSPIMLSFPHFYLADESLRTQVEGISPPMK 414
SEQIDNO:66   DKNPNNMCYCPAG-PPCAPHGLFNVSLCQYDSPILLSFPHFYMADQTLRTAVEGISPPEK 382
                 :*     *   *::::*:*: .:**.:* **** **:    . : *: *  :
```

LAMP HOMOLOGY DOMAIN

```
SEQIDNO:4    EDHETFVDINPLTGIILKAAKRFQINIYVKKLDDFVETGDIRTMVFPVMYLNESVHIDKE 420
SEQIDNO:56   EDHETFVDINPLTGIILKAAKRFQINIYVKKLDDFVETGDIRTMVFPVMYLNESVHIDKE 420
SEQIDNO:57   EDHETFVDINPLTGIILKAAKRFQINIYVKKLDDFVETGDIRTMVFPVMYLNESVLIDKE 420
SEQIDNO:58   DYHETFVDINPLTGIILRAAKRFQINVYVKKLDDFIETGNIRTMVFPVMYINESVLIDKD 420
SEQIDNO:59   EYHETFVDINPLTGIILRAAKRFQINVYVRKLDDFVETGNIQTLVFPVMYINESVLIDKE 420
SEQIDNO:60   EEHESFVDINPLTGIILRGAKRFQINTYVRKLDDFVETGDIRTMVFPVMYLNESVLIDKE 420
SEQIDNO:61   EEHETYLDINPTTGVPIRACKRAQLNIILKRVRGFPNTKFLNETIFPIMYVNETATIDDE 428
SEQIDNO:62   EEHESFVDINPLTGIILRGAKRFQINTYVKKLDDFVETGNIRTMVFPVMYLNESVLIDKE 420
SEQIDNO:63   EYHETFVDINPLTGVLLQAAKRMQINIHVRKLPEFFETGNIRTLIFPVMYINESVLIDEA 423
SEQIDNO:64   EHHMTFLDLNPLTGTLIQAAKRIQVNVYVRKINVYLITQDIQTLFFPVMHLNESVLIDDK 424
SEQIDNO:65   EKHQFFFDVQPKMGTTLRVRARIQINLAVSQVFDIKQVANFPDIIFPILWFEEGIDNLPD 474
SEQIDNO:66   DKHQLFIDVQPDMGTALRARARIQINLAVSQVVDIKQVANFPDIVFPILWFEEGIDSLPD 442
               : *  :.*::*  *  ::  *  *:*  : ::     .  :  .**::  ..:*
```

Trans. Domain    Cytoplasmic Tail

```
SEQIDNO:4    TASRLKSMINTTLIITNI----PYIIMALGVFFGLVFTWLACKGQGSMDEGTADERAPLI 476
SEQIDNO:56   TASRLKSMINTTLIITNI----PYIIMALGVFFGLVFTWLACKGQGSMDEGTADERAPLI 476
SEQIDNO:57   TASRLKSVINTTLIITNI----PYIIMALGVFFGFVFTWLACKGQGSMDEGTADERAPLI 476
SEQIDNO:58   TASRLKSVINTTLIITNI----PYIVMALGVFFGLIFTWLACRGQGSMDEGTPDERAPLI 476
SEQIDNO:59   TASRLKSVINTTLIVTNI----PYIIMALGVFFGLIFTWLACRGQGSTDEGTADERAPLI 476
SEQIDNO:60   TANQLKSVINTTLVVTNI----PYIIMALGVFFGLVFTWLACRGQGSMDEGTADERAPLI 476
SEQIDNO:61   SAAQMRMLLLIVTVVSNF----PVIILALGVILLVLIFLVCRNRQRKNEVKRIDFTEAF  484
SEQIDNO:62   TASQLKSVINTTLIVTNI----PYIIMALGVFFGLIFTWLACRGQGSTDEGTADERAPLI 476
SEQIDNO:63   SANKLKHVLLEASVVTGI----PFVIMAIGIVFGIVFSVLVCRAQGAREESTEEERSPLI 479
SEQIDNO:64   SAGRLRSILFQGRVVANI----PFIIMGLGIILAFLFTTLSCLQKRSRDEGTEEERGPLI 480
SEQIDNO:65   EVTDL--MRFAEQVPPKIRVALIVGLCALGVILLLSTF-CLIRNSHRQSTLHLEGSNY   530
SEQIDNO:66   EILDL--MKVATNIPPRAKFILTIALFGLGGFLVVAVI-CLVRKSHRQSTLHLEGSNY   498
                 :  :          :     : ..:*  .:  .:    *   :   :  .
```

FIG. 6 (cont.)

```
SEQIDNO:4   RT--------------------------------------------- 478
SEQIDNO:56  RT--------------------------------------------- 478
SEQIDNO:57  RT--------------------------------------------- 478
SEQIDNO:58  RT--------------------------------------------- 478
SEQIDNO:59  RT--------------------------------------------- 478
SEQIDNO:60  RT--------------------------------------------- 478
SEQIDNO:61  HSFATTKDETAYTQVSNQAEDSPENRNNQPLRNGSYIAMSPVEAQKC 531
SEQIDNO:62  RT--------------------------------------------- 478
SEQIDNO:63  RT--------------------------------------------- 481
SEQIDNO:64  RAS-------------------------------------------- 483
SEQIDNO:65  LATA------------QVDMNKKQNKDNQPARY-------------- 551
SEQIDNO:66  LATA------------SVDQAKKKAKMDNGMSSKSN------------ 522
            :
```

| LIMP-2 ||||||
|---|---|---|---|---|---|
| Accession No. | Species | SEQ ID NO: | Accession No. | Species | SEQ ID NO: |
| NP_005497.1 | H. sapiens | 4 | NP_775366.1 | D. rerio | 61 |
| XP_517214.2 | P. troglodytes | 56 | NP_446453.1 | R. norvegicus | 62 |
| XP_001096458.1 | M. mulatta | 57 | XP_420593.1 | G. gallus | 63 |
| XP_005639134.1 | C. lupus familiaris | 58 | NP_001016557.1 | X. tropicalis | 64 |
| NP_001095623.1 | B. Taurus | 59 | NP_726504.2 | D. Melanogaster | 65 |
| NP_031670.1 | M. musculus | 60 | XP_314345.2 | A. gambiae | 66 |

FIG. 6 (cont.)

HUMAN LIMBIC/SLAMP ALIGNMENT WITH ORTHOLOGOUS SEQUENCES

```
              SIGNAL SEQUENCE              LAMP HOMOLOGY DOMAIN
                                                    1
SEQIDNO:67   -MVRRVQPDRKQLPLV-LLRLLCL-LPTGLPVRSVDFNRGTDNITVRQGDTAILRCVVED 57
SEQIDNO:68   -MVRRVQPDRKQLPLV-LLRLLCL-LPTGLPVRSVDFNRGTDNITVRQGDTAILRCVVED 57
SEQIDNO:69   -MGARVQPDRKQLPLV-LLRLLCL-LPTGLPVRSVDFNRGTDNITVRQGDTAILRCVVED 57
SEQIDNO:70   -MVGRVQPDRKQLPLV-LLRLLCL-LPTGLPVRSVDFNRGTDNITVRQGDTAILRCVVED 57
SEQIDNO:71   -MVGRSQSDRNQLPLF-LLRLLCL-LPTGLPVRSGDFNRSTDNMTVRQGDTAILRCFVED 57
SEQIDNO:72   ----MSCLWIHSVFIPGFF--LLF-GFEGFPVISVESQRSTDNITIRQGDTTVIRCYVDD 53
SEQIDNO:102  -MVGRVQPDRKQLPLV-LLRLLCL-LPTGLPVRSVDFNRGTDNITVRQGDTAILRCVVED 57
SEQIDNO:103  -MVGRVQPDRKQLPLV-LLRLLCL-LPTGLPVRSVDFNRGTDNITVRQGDTAILRCVVED 57
SEQIDNO:104  -MVARVQPDRKQLPLV-LLRLLCL-LPTGLPVRSVDFNRGTDNITVRQGDTAILRCVVED 57
SEQIDNO:105  -MVARVQPDRKQLPLV-LLRLLCL-LPTGLPVRSVDFNRGTDNITVRQGDTAILRCVVED 57
SEQIDNO:106  ------------MSFAGEAA------SQILNKAEPLFISRSEAFKFAVGDTITLPCEVAS 42
SEQIDNO:107  ------MRPCLLHSIWMLGFVLCLLSLQGLPVRSGDFNRSTDNITVRQGDTAILRCFVED 54
SEQIDNO:108  -MLGARRPPRSQLPLV-LLRLLCL-LPTGLPVRSVDFNRGTDNITVRQGDTAILRCVVED 57
SEQIDNO:109  -MVGRVHPDRKQLPLV-LLRLLCL-LPTGLPVRGVDFTRGTDNITVRQGDTAILRCYVED 57
SEQIDNO:110  -MVARAQPDRKQLPLV-LLRLLCL-LPTGLPVRSVDFTRGTDNITVRQGDTAILRCFVED 57
SEQIDNO:111  ---MRTYW-LHSIWVL-GFFLSLF-SLQGLPVRSVDFTRGTDNITVRQGDTAILRCYVED 54
SEQIDNO:112  ------MRPCLLHSIWMLGFVLCLLSLQGLPVRSGDFNRSTDNITVRQGDTAILRCFVED 54
SEQIDNO:113  MQVGRKSCWRQ--LQASFFRLLCL-IPTGFPVRSVDMQRATDNITIRQGDTAIIRCYVDD 57
                        :         :: :..  ***   : * .

LAMP HOMOLOGY DOMAIN
                                2
SEQIDNO:67   KN-SKVAWLNRSGIIFAGHDKWSLDPRVELEKRHSLEYSLRIQKVDVYDEGSYTCSVQTQ 116
SEQIDNO:68   KN-SKVAWLNRSGIIFAGHDKWSLDPRVELEKRHSLEYSLRIQKVDVYDEGSYTCSVQTQ 116
SEQIDNO:69   KN-SKVAWLNRSGIIFAGHDKWSLDPRVELEKRHSLEYSLRIQKVDVYDEGSYTCSVQTQ 116
SEQIDNO:70   KN-SKVAWLNRSGIIFAGHDKWSLDPRVELEKRHALEYSLRIQKVDVYDEGSYTCSVQTQ 116
SEQIDNO:71   KS-SKVAWLNRSGIIFAVDDKWSLDPRVELEKRSPFEYSLRIQKVDVSDEGPYICSVQTN 116
SEQIDNO:72   KV-SKVAWLNRSNIIFAGEDKWSLDPRVELVTQGQLEYSLRIQKVDVFDEGPYTCSIQTK 112
SEQIDNO:102  KN-SKVAWLNRSGIIFAGHDKWSLDPRVELEKRHALEYSLRIQKVDVYDEGSYTCSVQTQ 116
SEQIDNO:103  KN-SKVAWLNRSGIIFAGHDKWSLDPRVELEKRHSLEYSLRIQKVDVYDEGSYTCSVQTQ 116
SEQIDNO:104  KN-SKVAWLNRSGIIFAGHDKWSLDPRVELEKRHSLEYSLRIQKVDVYDEGSYTCSVQTQ 116
SEQIDNO:105  KN-SKVAWLNRSGIIFAGHDKWSLDPRVELEKRHSLEYSLRIQKVDVYDEGSYTCSVQTQ 116
SEQIDNO:106  PGTYVLAWKRGIAILTAGSVKVTPDPRVRLVN----GYSLQIRDAVPQDAGDYICQIAML 98
SEQIDNO:107  RS-SRVAWLNRSGIIFAGDDKWSLDPRVELEKRSLLEYSLRIQKVDVSDEGPYTCSVQTK 113
SEQIDNO:108  KN-SKVAWLNRSGIIFAGHDKWSLDPRVELEKRHSLEYSLRIQKVDVYDEGSYTCSVQTQ 116
SEQIDNO:109  KS-SKVAWLNRSGIIFAGHDKWSLDPRVELEKRTALEYSLRIQKVDVYDEGSYTCSVQTQ 116
SEQIDNO:110  RS-SKVAWLNRSGIIFAGEDKWSLDPRVELEKRSPLEYSLRIQKVDVYDEGSYTCSVQTQ 116
SEQIDNO:111  RS-SKVAWLNRSGIIFAGEDKWSLDPRVELEKRNPLEYSLRIQKVDVYDEGSYTCSVQTQ 113
SEQIDNO:112  RS-SRVAWLNRSGIIFAGDDKWSLDPRVELEKRSLLEYSLRIQKVDVSDEGPYTCSVQTK 113
SEQIDNO:113  KV-SKVAWLNRSNIIFAGQDKWSLDPRVDLVTKGQLEYSLRIQKVDVYDEGSYTCSIQTK 116
              :**  .   *:  *   *: **** *.    ***:*..  *  * * *.:
```

FIG. 7

LAMP HOMOLOGY DOMAIN 3

```
SEQIDNO:67   HEPKTSQVYLIVQVPPKISNISS--DVTVNEGSNVTLVCMANGRPEPVITWRHLTP---T 171
SEQIDNO:68   HEPKTSQVYLIVQVPPKISNISS--DVTVNEGSNVTLVCMANGRPEPVITWRHLTP---T 171
SEQIDNO:69   HEPKTSQVYLIVQVPPKISNISS--DVTVNEGSNVTLVCMANGRPEPVITWRHLTP---T 171
SEQIDNO:70   HEPKTSQVYLIVQVPPKISNISS--DVTVNEGSNVTLVCMANGRPEPVITWRHLTP---L 171
SEQIDNO:71   QHTKTMQVYLIVQVPPKISNISA--DITVNEGSNVTLMCIAYGRPEPMITWRHLTP---T 171
SEQIDNO:72   QQSKTSQVYLIVQVPAIIYKVSE--DITVNEGSNVALTCLANGRPDPAITWRLLNP---S 167
SEQIDNO:102  HEPKTSQVYLIVQVPPKISNISS--DVTVNEGSNVTLVCMANGRPEPVITWRHLTP---L 171
SEQIDNO:103  HEPKTSQVYLIVQVPPKISNISS--DVTVNEGSNVTLVCMANGRPEPVITWRHLTP---T 171
SEQIDNO:104  HEPKTSQVYLIVQVPPKISNISS--DVTVNEGSNVTLVCMANGRPEPVITWRHLTP---T 171
SEQIDNO:105  HEPKTSQVYLIVQVPPKISNISS--DVTVNEGSNVTLVCMANGRPEPVITWRHLTP---T 171
SEQIDNO:106  DPR-EITHSVEILVPPKITHVTSGGHLQVRKGSPVRLECSATGNPMPNITWTRKNNLLPN 157
SEQIDNO:107  QHTKTTQVYLIVQVPPKISNISA--DITVNEGSNVTLMCIAYGRPEPMITWRHLTP---T 168
SEQIDNO:108  HEPKTSQVYLIVQVPPKISNISS--DVTVNEGSNVTLVCMANGRPEPVITWRHLTP---T 171
SEQIDNO:109  HQPKTSQVYLIVQVPPKISNISS--DVTVNEGSNVTLVCMANGRPEPVITWRHLTP---T 171
SEQIDNO:110  HHPKTSQVYLIVQVPPKISNISS--DITVNEGSNVTLVCMANGRPEPVITWRHLTP---T 171
SEQIDNO:111  HHPKTSQVYLIVQVPPKISNISS--DITVNEGSNVTLVCMANGRPEPVITWRHLTP---T 168
SEQIDNO:112  QHTKTTQVYLIVQVPPKISNISA--DITVNEGSNVTLMCIAYGRPEPMITWRHLTP---T 168
SEQIDNO:113  QQPKTSQVYLIVQVPASIYQVSN--DITVNEGSNVTLSCLANGRPDPAITWRLLNP---S 171
              .   : :**  *  :::     .: *.:** * * * * *.* * *** .
```

LAMP HOMOLOGY DOMAIN 4

```
SEQIDNO:67   GREFEGEEEYLEILGITREQSGKYECKAANEVSSADVKQVKVTVNYPPTITESKS     230
SEQIDNO:68   GREFEGEEEYLEILGITREQSGKYECKAANEVSSADVKQVKVTVNYPPTITESKS-NEAT 230
SEQIDNO:69   GREFEGEEEYLEILGITREQSGKYECKAANEVSSADVKQVKVTVNYPPTITESKS-NEAT 230
SEQIDNO:70   GREFEGEEEYLEILGITREQSGKYECKAANEVSSADVKQVKVTVNYPPTITESKS-NEAT 230
SEQIDNO:71   ARDFEGEEEFLEIQGITREQSGRYECKAANEVASADVKQVRVTVNYPPIITESNS-NEAT 230
SEQIDNO:72   AEALDV-GEYLEISGVVRSQAGRYECKASNDVSTPDVKYVNVVVNYPPYIKDVRS-SETA 225
SEQIDNO:102  GREFEGEEEYLEILGITREQSGKYECKAANEVSSADVKQVKVTVNYPPTITESKS-NEAT 230
SEQIDNO:103  GREFEGEEEYLEILGITREQSGKYECKAANEVSSADVKQVKVTVNYPPTITESKS-NEAT 230
SEQIDNO:104  GRELEGEEEYLEILGITREQSGKYECKAANEVSSADVKQVKVTVNYPPTITESKS-NEAT 230
SEQIDNO:105  GREFEGEEEYLEILGITREQSGKYECKAANEVSSADVKQVKVTVNYPPTITESKS-NEAT 230
SEQIDNO:106  GEEQFT-NPVYVIENMDRHKGGTYICTANNGVGQVATSQIILHVLYPPEISVENPTVYSG 216
SEQIDNO:107  ARDFEGEEEFLEIQGITREQSGRYECKAANEVASADVKQVRVTVNYPPIITESNS-NEAT 227
SEQIDNO:108  GREFEGEEEYLEILGITREQSGKYECKAANEVSSADVRQVKVTVNYPPTITESKS-NEAT 230
SEQIDNO:109  GREFEGEEEYLEILGITREQSGKYECKAANEVSSADVKQVKVTVNYPPTITESKS-NEAT 230
SEQIDNO:110  GKEFEGEEEYLEILGITREQSGKYECKAANEVASADVKQVRVTVNYPPTITESKS-NEAA 230
SEQIDNO:111  GKEFEGEEEYLEILGITREQSGKYECKAANEVASADVKQVRVTVNYPPTITESKS-NEAA 227
SEQIDNO:112  ARDFEGEEEFLEIQGITREQSGRYECKAANEVASADVKQVRVTVNYPPIITESKS-NEAT 227
SEQIDNO:113  AEPLDG-EEYLDIIGIMRTQAGRYECKASNDVATPDVKYVNVIVNYPPTIKKTQS-SETP 229
              ..           *  .: *   :.*  * * *.* * *,    . :   :    * *** *.   .   :
```

FIG. 7 (cont.)

LAMP HOMOLOGY DOMAIN

```
                        5                                               6
SEQIDNO:67   TGRQASLKCEASAVPAPDFEWYRDDTRINSANGLEIKSTEGQSSLTVTNVTEEHYGNYTC 290
SEQIDNO:68   TGRQASLKCEASAVPAPDFEWYRDDTRINSANGLEIKSTEGQSSLTVTNVTEEHYGNYTC 290
SEQIDNO:69   TGRQASLKCEASAVPAPDFEWYRDDTRINSANGLEIKSTEGQSSLTVTNVTEEHYGNYTC 290
SEQIDNO:70   TGRQASLKCEASAVPAPDFEWYRDDTRINSANGLEIKSTEGQSSLTVTNVTEEHYGNYTC 290
SEQIDNO:71   TGKQAILRCEASAVPAPDFEWYKDDTRINSAQGLEIRNTGSRSVLMVANVTEEHYGNYTC 290
SEQIDNO:72   VGQAGVLHCEASAVPQPEFEWYRDERRLSSSQSLTIQVSGSRTVLVVANVTEEDYGNYTC 285
SEQIDNO:102  TGRQASLKCEASAVPAPDFEWYRDDTRINSANGLEIKSTEGQSSLTVTNVTEEHYGNYTC 290
SEQIDNO:103  TGRQASLKCEASAVPAPDFEWYRDDTRITSANGLEIKSTEGQSSLTVANVTEEHYGNYTC 290
SEQIDNO:104  TGRKASLKCEASAVPAPDFEWYRDDTRINSANGLEIKSTEGQSSLTVTNVTEEHYGNYTC 290
SEQIDNO:105  TGRKASLKCEASAVPAPDFEWYRDDTRINSANGLEIKSTEGQSSLTVTNVTEEHYGNYTC 290
SEQIDNO:106  EGQEAMLVCIVHGESQPEVLWHKDTMQIDQTERHVIENRGARHTLIIRKVHPQDFGNYSC 276
SEQIDNO:107  TGKQAILRCEASAVPAPDFEWYKDDTRINSAQGLEIRNTGSRSVLMVANVTEEHYGNYTC 287
SEQIDNO:108  TGRKASLKCEASAVPAPDFEWYRDDTRINSANGLEIKSTEGQSSLTVTNVTEEHYGNYTC 290
SEQIDNO:109  TGRQASLKCEASAVPAPDFEWYRDDTRINSANGLEIKSIEGQSLLMVTNVTEEHYGNYTC 290
SEQIDNO:110  TGRQALLRCEASAVPTPDFEWYRDDTRINSANGLEIKSTGSQSLLMVANVTEEHYGNYTC 290
SEQIDNO:111  TGRQALLRCEASAVPTPDFEWYRDDTRINSANGLEIKSTGSQSLLMVANVTEEHYGNYTC 287
SEQIDNO:112  TGKQAILRCEASAVPAPDFEWYKDDTRINSAQGLEIRNTGSRSVLMVANVTEEHYGNYTC 287
SEQIDNO:113  VGRNGTLRCEVTAVPTPEFEWYRDDKRLANTQSITIQTSGTTTSLTIANITEEDYGNYTC 289
              *: . *  *  . .     *:.  *::*    :: .::    *.      *  : ::  :.:***:*
```

Trns Memb.

```
SEQIDNO:67   VAANKLGVTNASLVLFRPGSVRGINGSISLAVPLWLLAASLLCLL-SKC------------ 338
SEQIDNO:68   VAANKLGVTNASLVLFRPGSVRGINGSISLAVPLWLLAASLLCLL-SKC------------ 338
SEQIDNO:69   VAANKLGVTNASLVLFRPGSVRGINGSISLAVPLWLLAASLLCLL-SKC------------ 338
SEQIDNO:70   VAANKLGVTNASLVLFSKYAKTEPDSMQVIE-FLHIDLKSIRHPL-KVNPIQK-------- 341
SEQIDNO:71   VAANKLGITNTSLYLYI-GPGTPIDNATSLAASLWLMANILLCLF-CTC------------ 337
SEQIDNO:72   VATNRLGVHNASVFLYKPGMGRDINSAGCICQSLWLLLLCVSSAL-LQC------------ 333
SEQIDNO:102  VAANKLGVTNASLVLFRPGSVRGINGSISLAVPLWLLAASLFCLL-SKC------------ 338
SEQIDNO:103  VAANNLGVTNASLVLFRPGSVRGINGSISLAVPLWLLAASLLCLL-SKC------------ 338
SEQIDNO:104  VAANNLGVTNASLVLFRPGSVRGINGSISLAVPLWLLAASLLCLL-SKC------------ 338
SEQIDNO:105  VAANNLGMTNASLVLFRPGSVRGINGSISLAVPLWLLAASLLCLL-SKC------------ 338
SEQIDNO:106  IADNQLGKTRKTVTLGKPKTAVF---RSVPNSQWKDKYNISWIVDSHSPIEEFKLYYRQ   333
SEQIDNO:107  VAANKLGITNTSLYLYI-GPGTPIDSATSLAASLWLMANLLFCLF-CTC------------ 334
SEQIDNO:108  VAANNLGVTNASLVLFRPGSVRGINGSISLAVPLWLLAASLLCLL-SKC------------ 338
SEQIDNO:109  VAANKLGVTNASLILFRPGSVRGINGSISLAVPLWLLAASLFCLL-SKC------------ 338
SEQIDNO:110  VAANKLGVTNASLYLYRPGTGRVDNGSVSLAVPLWLLAASLLCLL-SKC------------ 338
SEQIDNO:111  VAANKLGVTNASLYLYRPGTGRVDNGSMSLAVPLWLLAASLLCLL-SKC------------ 335
SEQIDNO:112  VAANKLGITNTSLYLYI-GPGTPIDSATSLAASLWLMANLLFCLF-CTC------------ 334
SEQIDNO:113  VASNRLGVQNASLFLYRPGTGRDINGSACVSQSLWLLLASFACLF-LKC------------ 337
              :* *.**  . :: *                 :           .  .
```

FIG. 7 (cont.)

```
SEQIDNO:67   ------------------------------------------------------------   338
SEQIDNO:68   ------------------------------------------------------------   338
SEQIDNO:69   ------------------------------------------------------------   338
SEQIDNO:70   ------------------------------------------------------------   341
SEQIDNO:71   ------------------------------------------------------------   337
SEQIDNO:72   ------------------------------------------------------------   333
SEQIDNO:102  ------------------------------------------------------------   338
SEQIDNO:103  ------------------------------------------------------------   338
SEQIDNO:104  ------------------------------------------------------------   338
SEQIDNO:105  ------------------------------------------------------------   338
SEQIDNO:106  MTFSIGQLQPLQTDWRDIVLPAFPYSHHYTQGMSYLIRGLEPDQQYEARVQSRNRYGWSD   393
SEQIDNO:107  ------------------------------------------------------------   334
SEQIDNO:108  ------------------------------------------------------------   338
SEQIDNO:109  ------------------------------------------------------------   338
SEQIDNO:110  ------------------------------------------------------------   338
SEQIDNO:111  ------------------------------------------------------------   335
SEQIDNO:112  ------------------------------------------------------------   334
SEQIDNO:113  ------------------------------------------------------------   337

SEQIDNO:67   -------------------------   338
SEQIDNO:68   -------------------------   338
SEQIDNO:69   -------------------------   338
SEQIDNO:70   -------------------------   341
SEQIDNO:71   -------------------------   337
SEQIDNO:72   -------------------------   333
SEQIDNO:102  -------------------------   338
SEQIDNO:103  -------------------------   338
SEQIDNO:104  -------------------------   338
SEQIDNO:105  -------------------------   338
SEQIDNO:106  FSESFLFTTSNTGKWMGQCCTNPG    417
SEQIDNO:107  -------------------------   334
SEQIDNO:108  -------------------------   338
SEQIDNO:109  -------------------------   338
SEQIDNO:110  -------------------------   338
SEQIDNO:111  -------------------------   335
SEQIDNO:112  -------------------------   334
SEQIDNO:113  -------------------------   337
```

| LIMBIC/LSAMP | | | | | |
|---|---|---|---|---|---|
| Accession No. | *Species* | SEQ ID NO: | Accession No. | *Species* | SEQ ID NO: |
| NP_002329.2 | *H. sapiens* | 67 | NP_001192297.1 | *B. Taurus* | 105 |
| XP_516662.2 | *P. troglodytes* | 68 | XP_312298.5 | *A. gambiae* | 106 |
| XP_002716722.1 | *O. cuniculus* | 69 | NP_001096385.1 | *X. tropicalis* | 107 |
| NP_780757.1 | *M. musculus* | 70 | XP_003434117.1 | *C. lupus familiaris* | 108 |
| NP_001086181.1 | *X. laevis* | 71 | XP_001362972.1 | *M. domestica* | 109 |
| NP_001034921.1 | *D. rerio* | 72 | NP_990205.1 | *G. gallus* | 110 |
| NP_058938.1 | *R. norvegicus* | 102 | XP_002190582.1 | *T. guttate* | 111 |
| XP_001502710.1 | *E. caballus* | 103 | NP_001096385.1 | *X. tropicalis* | 112 |
| NP_001231626.1 | *S. scrofa* | 104 | XP_003449349.1 | *O. niloticus* | 113 |

FIG. 7 (cont.)

HUMAN ENDOLYN ALIGNMENT WITH ORTHOLOGOUS SEQUENCES

```
                SIGNAL SEQUENCE            LAMP HOMOLOGY DOMAIN
SEQIDNO:5   MSRLSRSLLWAATCLGVLCVLSADKNTTQH-PNVTTLAPISNVTSAP-----V-TSLPLV 53
SEQIDNO:73  MSGSSRRLLWAATCLAVLCVSAAQPNITTLAPNVTEVPT-----TT------TKVVPTTQM 50
SEQIDNO:74  MSRLSRSLLWAVTCLAVLCVLSAEENPTPH-TNVTSLAPTSNITSAP-----V-TSLPLV 53
SEQIDNO:75  MLGLSRQLLWAVGCLAALCVLTAAKNSTIL-PPSTTTPWLSPPTTQT-----TSAPPKTL 54
SEQIDNO:76  MSGLSRPLLLAVGCLAALCVITAAGNTTLA-PNVTTASS-PPPTTTTVPVSPTTLSPLPV 58
SEQIDNO:77  MSGLSRPLLLAVGYLAALCVITAARNTTVT-PNVTTPSS-PPPTTATVPVSPTTLTPPPV 58
SEQIDNO:78  MSGLSRQLCWAAACLAALCALTAAQSFSSD-PNGTTTTTQATTDAAT----TRVTTAAPA 55
SEQIDNO:79  MSGASRGLFWAATCLAALCLSAAQSNS-SASPNVTDPPT-----TT------SKVVPTTLT 49
                 *  ** *  *. *..**  :*   .       *               :

LAMP HOMOLOGY DOMAIN
                   1    2 3        4     5        6       7       8
SEQIDNO:5   TTPAPETCEGRNSCVSCFNVSVV-NTTCFWIECKD--ESYCSHNSTVSDCQVGNTTDFCS 110
SEQIDNO:73  PTVLPETCASFNSCVSCVNATFTNNITCFWLHCQEANKTYCAN-EPLSNCSQVNRTDLCS 109
SEQIDNO:74  TTPAPETCEGRNSCVSCFNASTV-NTTCFWIECKD--ESYCSHNSTVSDCQVGNTTDFCS 110
SEQIDNO:75  PTPAPEICENRNSCISCFDA----NNTCFWIECKG--KSYCSDNSTVSDCHVVNGTDFCS 108
SEQIDNO:76  TTPAPDICGSRNSCVSCVDG----NATCFWIECKG--KSYCSDNSTAGDCKVVNTTGFCS 112
SEQIDNO:77  TTPAPDICGSRNSCISCVDG----NATCFWIECKG--KSYCSDNSTVSDCKVVNTTGFCA 112
SEQIDNO:78  TTPAPDPCDNRNSCVSCVNTSVD-ATACSWIECKE--KSYCSHNTTVSDCQVVNSTQLCS 112
SEQIDNO:79  TTKPPETCESFNSCVSCVNATLTNNITCVWLDCHEANKTYCSS-ELVSNCTQKTSTDSCS 108
              *  *:  *  . ***:**.:    :* *:.*:   ::**:    ..:*  .  *  *:

LAMP HOMOLOGY DOMAIN
SEQIDNO:5   VST-ATPVPTANSTAKPTVQPSPSTT-SKTVTTSGTTNNTVTPTSQPVRKSTFDAASFIG 168
SEQIDNO:73  VIPPTTPVPT-NSTAKPTTRPSSPTPTPSVVTSAGTTNTTLTPTSQPERKSTFDAASFIG 168
SEQIDNO:74  VPT-ATLVPTANSTAKPTVQPSPSTT-SKTVTTSGTTNTTVTPTSQPVRKSTFDAASFIG 168
SEQIDNO:75  GPT-VTPLPT-NSTAKTTTLPSPSSA-STTATTSGTTNTTLAPTTQPMRKSTFDAASFIG 165
SEQIDNO:76  VPT-TTPTPT-NSTAKTTTLPSTTTT-STTATTSGTTNTTLSPTIQPTRKSTFDAASFIG 169
SEQIDNO:77  VPT-TTPTPT-NSTAKTTTLPSTTTT-STTATTSGTANTTLTPTIQPMRKSTFDAASFIG 169
SEQIDNO:78  APE-PTMMPT-NSTAKTTTQPSSSTA-TTTATTSGTTNITLSPTSQPGRKSTFDAASFIG 169
SEQIDNO:79  VIP-TTPVPT-NSTAKPTTRPSSPTPTPSVVTSAGATNTTVTPTSQPERKSTFDAASFIG 166
                 *  ** ***** *. **   :    ...*::*::* *::** ** ***********

Trns Memb.   Cytoplasmic Tail
SEQIDNO:5   GIVLVLGVQAVIFFLYKFCKSKERNYHTL          197
SEQIDNO:73  GIVLVLGVQAVIFFLYKFCKSKERNYHTL          197
SEQIDNO:74  GIVLVLGVQAVIFFLYKFCKSKERNYHTL          197
SEQIDNO:75  GIVLVLGVQAVIFFLYKFCKSKERNYHTL          194
SEQIDNO:76  GIVLVLGVQAVIFFLYKFCKSKERNYHTL          198
SEQIDNO:77  GIVLVLGVQAVIFFLYKFCKSKERNYHTL          198
SEQIDNO:78  GIVLILGVQAVIFFLYKFCKSKERNYHTL          198
SEQIDNO:79  GIVLVLGVQAVIFFLYKFCKSKERNYHTL          195
            ****:************************
```

FIG. 8

| | Endolyn | | | | |
|---|---|---|---|---|---|
| Accession No. | Species | SEQ ID NO: | Accession No. | Species | SEQ ID NO: |
| NP_006007.2 | H. sapiens | 5 | NP_001039506.1 | B. taurus | 76 |
| NP_058594.1 | M. musculus | 73 | XP_004011265.1 | O. aries | 77 |
| XP_001091286.1 | M. mulatta | 74 | XP_532256.2 | C. lupus familiaris | 78 |
| XP_001924661.2 | S. scrofa | 75 | NP_114000.1 | R. norvegicus | 79 |

FIG. 8 (cont.)

HUMAN MACROSAILIN ALIGNMENT WITH ORTHOLOGOUS SEQUENCES

SIGNAL SEQUENCE      LAMP HOMOLOGY DOMAIN 1

```
                            1
SEQIDNO:80  MRLAVLFSGALLGL-LAAQGTGNDCPHKKSATLLPSFTVTPTVTEST----GTTSHRTTK 55
SEQIDNO:81  MRLAVLFSGALLGL-LAAQGTGNDCPHKKSATLLPSFTVTPTVTEST----GTTSHRTTK 55
SEQIDNO:82  MRLAVFFSGALLGL-LAAQGTGNDCPHKKSATLLPSFTVTPTATESTPS-PGTTSHRTTK 58
SEQIDNO:83  MRLPVCL--ILLGP-LIAQGTEEDCPHKKAVTLLPSFTMTPTATESTAS-PTTSHRPTTT 56
SEQIDNO:84  MRLAVLFLGALLGL-LAAQGTGNDCPHKKSATLLPSFTVTPTATEST----GTTSHRTTK 55
SEQIDNO:85  MRFPVCL--TLLVL-LVAQGTGKDCPHKKAATLLPSFTETPTTTGSTAS-PTTTHRPTTT 56
SEQIDNO:86  MRPAVFFLGALVGL-LAAQGTRSDCPHKKSATLLPSFTVTPTATESTGS-PGTTSHSTTT 58
SEQIDNO:87  MRLAVLFSGALLGL-LAAQETGNDCPHKKSATLLPSFTVTPTATESTAS-PGTTSHQTTQ 58
SEQIDNO:88  MRLPVLFLA-LLGL-HAA------------------------------S-SGTTSHRTTK 27
SEQIDNO:89  MTLAVLFLGALLGL-LAESTTSH------------------------------------- 22
SEQIDNO:90  MRLAVLFSGALLGL-LAAQGTGNDCPHKKSATLLPSFTVTPTATEST----GTTSHRTTK 55
SEQIDNO:91  MRLSLLLSGILLGL-LAEQGAGDKCPQEKSVTLVPSFTVTTIATERSTTSPETTTSSGS- 58
SEQIDNO:92  --------MGLTLPLPAQGSQCRANCPHKKSATLVPSFTVTPTATSG----PTTTAHQTTT 49
                     :
```

LAMP HOMOLOGY DOMAIN 1

```
SEQIDNO:80  SHKTTTHRTTT-------TGTTSHGPTTATHNPTTTSHGNVTVHPTSNSTATSQGPSTAT 108
SEQIDNO:81  SHKTTTHRTTT-------TGTASHGPTTATHNPTTTSHGNVTVHPTSNSTATSQGPSTAT 108
SEQIDNO:82  SHRTTTWRISTTTHTTNTTGTTSSESPTATHSPA-------------------------- 92
SEQIDNO:83  SHGNVTVH---------T-----SSGPTTVTHNPA-------------------------- 77
SEQIDNO:84  SHKTTTHRTTT-------TGTTSHRPTTATHNPTTTSHRNATVHPTSNSTATSQGPSTAT 108
SEQIDNO:85  SHRPTTTS---------HRPTTTSHRPTTTSHRPT-------------------TTS 85
SEQIDNO:86  AETT--------------SHAPNTTTHQ-------------------------------- 72
SEQIDNO:87  SHRTTTT-----------GTTSDHPTTATHNP---------------------------- 79
SEQIDNO:88  NPHTT-------SHSTATPGTTSHRPTTAT------------------------------ 50
SEQIDNO:89  --RTTTPR--------TTTTGTTSHGPTTVTHNPA------------------------- 47
SEQIDNO:90  SHKTTTHRTTT-------TGTTSHRPTTATHNPNTTSHRNATVHPTSNSTATSQGPSTAT 108
SEQIDNO:91  --TATTYRTS--------TAATTPHS---------------------NSTATS------- 80
SEQIDNO:92  DHGTTTSHETTTSQGTSTHGTSTPHTTTTGHGTT-TGHQN------TSH----------- 91
```

LAMP HOMOLOGY DOMAIN 1

```
SEQIDNO:80  HSPATTSHGNATVHPT-SNSTATSPG-----------F-T--SSAHPEPPPPSPSPSPTSK 154
SEQIDNO:81  HSPATTSHGNATVHPT-SNSTATSPG-----------F-T--SSAHPEPPPPSPSPSPTSK 154
SEQIDNO:82  ---TTTSHQNTTVHPT-SNITATSPG-----------PST--RSPHPEP-PPSPSPSPGSK 135
SEQIDNO:83  ---TTTSHGNATISHATVSPTT------NG-TATSPRSST--VGPHPGPPPPSP--SPRSK 124
SEQIDNO:84  HRPATTSHGNATVHPT-SNSTATSPG-----------L-T--SSAHPGPPPPSPSPSPASK 154
SEQIDNO:85  HRPTTTSHGNATV-----SP-----------TTNSPGFST--VGPHPGPPPPSPSPSPSST 128
SEQIDNO:86  -APTTPGHRNTTIHPTTSNSTSNTTGTTGTGKPHTSTSY--TQPGPGPRPPPPSPGPGPQ 129
SEQIDNO:87  ---TTTSHGNTTVHPTTSNSTVTSPG----------SAS--SSPHPRPPPPSPSPSPGSK 124
SEQIDNO:88  ---PTTGHGNVTVHPTTSNTTSNTTTTTGTS---PGFST--STPHPGPPPPPSPSPGSR 102
SEQIDNO:89  ---TTTSHGNATVHPT-SSSTATSPG-----------SST--RPPHPGPPPPSPSPSPGSQ 91
SEQIDNO:90  HRPATTSHGNATVHPT-SNSTATSPG-----------L-T--SSAHPGPPPPSPSPSPASK 154
SEQIDNO:91  --YSTTSEGTAVTHGTTTSPRN---------------TSTT--STSQSVPPPSPQPTSSPS 123
SEQIDNO:92  --STTTSHGTSTPHKTTTRHPTTSHGTTTSHGTSTGHWTARPTIRPGPPPPPP----SPG 145
                  *  .. .                                    * *** *
```

FIG. 9

LAMP HOMOLOGY DOMAIN
2

```
SEQIDNO:80   ETIGDYTWTNGSQPCVHLQAQIQIRVMYTTQGGG---------EAWGISVLNPNK-TKVQ 204
SEQIDNO:81   ETIGDYTWTNGSQPCVHLQAQIQIRVMYTTQGGG---------EAWGISVLNPNK-TKVQ 204
SEQIDNO:82   EAIGDYTWSNGSQPCVRLQAQIQIRVLYPTQGGG---------EAWGISVLNPNR-TKAQ 185
SEQIDNO:83   GALGNYTWANGSQPCVQLQAQIQIRILYPIQGGRKVKLKWGLKRAWGISVLNPNK-TKVQ 183
SEQIDNO:84   ETIGDYMWTNGSQPCVHLQAQIQIRVMYTTQGGG---------EAWGISVLNPNK-TKVQ 204
SEQIDNO:85   GALGNYTWTNGSQPCVQLQAQIQIRILYLTQGGK---------KAWGLSVLNPNK-TKVQ 178
SEQIDNO:86   DAIGDYTWTTGSQPCARLQARIQIGVVYPTQAGG---------QAWGISVLNPNS-TKPW 179
SEQIDNO:87   EAIGDYIWTNGSQPCVRLQAQIQIRVLYPTLGGG---------KAWGISVLNPNK-TKAQ 174
SEQIDNO:88   EAVGNYTWTNGSQPCVQLQAQIQIRVLYPTQGGG---------QAWGMSVLNPNR-TKAQ 152
SEQIDNO:89   EAIGDYTWTNGSQPCVQLQAQIQIRVLYPTQGGG---------EAWGISVLNPNK-TKAL 141
SEQIDNO:90   ETIGDYMWTNGSQPCVHLQAQIQIRVMYTTQGGG---------EAWGISVLNPNK-TKVQ 204
SEQIDNO:91   GAVGDYIGANGSQLCVHLRAQIQMRVLYQASGGG---------KLWGIFVLNPNR-TMAQ 173
SEQIDNO:92   KAVGNYTVFNGSQPCLRLRAEIRLWVLYQAQEEGEAPPVSG------AASFPPPRPRPVA 199
             ::*:*    .*** * :*:*.*:: ::*                     : *
```

LAMP HOMOLOGY DOMAIN
3

```
SEQIDNO:80   GSCEGAHPHLLLSF----PYGHLSFGFMQDLQQ--KVVYLSYMAVEYNVSFPHAAQWTFS 258
SEQIDNO:81   GSCEGAHPHLLLSF----PYGHLSFGFMQDLQQ--KAVYLSYMAVEYNVSFPHAAQWTFS 258
SEQIDNO:82   GGCEGTHSHLLLSF----PSGQLSFGFKQDPLQ--SAVYLNYMAVEYNVSFPQAVQWTFS 239
SEQIDNO:83   GGCDGTHPHLSLSF----PYGQLTFGFKQDLHQSPSTVYLDYMAVEYNVSFPQAAQWTFM 239
SEQIDNO:84   GSCEGAHPHLLLSF----PYGHLSFGFMQDLQQ--RVVYLSYMAVEYNVSFPHAAQWTFS 258
SEQIDNO:85   GGCDSAHPHLALSF----PYGQLTFGFKQDRHQSHSTVYLNYMAVEYNVSFPQAAQWTFS 234
SEQIDNO:86   GDCDGARPHLLLSF----PFGQLSFGFTQEPQQ--GSVYLDYLALQYNVSFPQAAQWTFS 233
SEQIDNO:87   GGCA--HPHLLLSF----PYGQLSFGFKQEPLQ--STVYLNYIAVEYNVSFPQAAQWTFL 226
SEQIDNO:88   GGCEGPRPHLLLSF----PYGQLSFGFKQDPGQGQSAVYLSYLAVEYNVSFPQAARWTFS 208
SEQIDNO:89   GGCEGAHPHVRLSF----PYGQLTFGFKQQPQE--STVYLNYMAVEYNVSFPRAAQWTFS 195
SEQIDNO:90   GSCEGAHPHLLLSF----PYGHLSFGFMQDLQQ--RVVYLSYMAVEYNVSFPHAAQWTFS 258
SEQIDNO:91   GNCEANHSSLILSF----PNGKLIFGFKQDSIK--KIVYLSHLATEFNVSFPSATRWIFS 227
SEQIDNO:92   GEGDGERSRVTPVASAMTVEGGSRAGFAM------------------------------ 228
             *    :  :          *      **
```

LAMP HOMOLOGY DOMAIN
4                                                   5

```
SEQIDNO:80   AQNASLRDLQAPLGQSFSCSNSSIILSPAVHLDLLSLRLQAAQLPHTGVFGQSFSCPSDR 318
SEQIDNO:81   AQNASLRDLQAPLGRSFSCSNSSIILSPAVHLDLLSLRLQAAQLPHTGVFGQSFSCPSDR 318
SEQIDNO:82   VQNSSLRDLQTPLGHSFSCRNASIIVSPALHLDLLSLKLQAAQLSPSGAFGPSFSCPNDK 299
SEQIDNO:83   AQNSSLRELQAPLGQSFCCGNASIVLSPAVHLDLLSLRLQAAQLPDKGHFGPCFSCNRDQ 299
SEQIDNO:84   AQNASLRDLQAPLGQSFSCSNSSIILSPAVHLDLLSLRLQAAQLPHTGVFGQSFSCPSDR 318
SEQIDNO:85   AQNSSLQELQAPLGQSFCCGNTSIVLSPAIHLDLLSLRLQAAQLPDKGHFGPCFSCASDQ 294
SEQIDNO:86   GQNASLRALQAPLGQSFSCRNASILLTPALRLDLHLKLQAAQLPPSGAFGPSFSCPSEH 293
SEQIDNO:87   VQNSSLRDLQAPLGQRFSCRNASIALSPAFHLDLLSLKLQAAQLTPTGAFGPSFSCPSDQ 286
SEQIDNO:88   AQNASLRDLQAPLGQSFSCRNASIAVSPALHLDLLSLRVQAAQLPRTGIFGPSFSCPADH 268
SEQIDNO:89   VQNSSLRDLQTPVGRSYSCRNASIILSTAFHLDLLSLKLQAAQLPPTGNFGPSFSCPSDQ 255
SEQIDNO:90   AQNASLRDLQAPLGQSFSCSNSSIILSPAVHLDLLSLRLQAAQLPHTGVFGQSFSCPSDR 318
SEQIDNO:91   VENSSLQDLQTPLGHSFSCRNRSIALSPDIHLDLLSLQLQAAQLSSSGAFGAAFSCSADL 287
SEQIDNO:92   -LGAEVRSRAPSLGRAGKTRL--RIHPVVVLQ-------HTYYV---------------- 263
             .:.::      :*:         . *:       :
```

FIG. 9 (cont.)

```
                     Trans. Domain      Cyto Tail
SEQIDNO:80   -SILLPLIIGLILLGLLALVLIAFCIIRRRPSAYQAL   354
SEQIDNO:81   -SILLPLIIGLILLGLLALVLIAFCIIRRRPSAYQAL   354
SEQIDNO:82   -SILLPLIIGLILLGLLTLVLVTFCIIRRRPPTYQPL   335
SEQIDNO:83   -SLLLPLIIGLVLLGLLTLVLIAFCITRRRQSTYQPL   335
SEQIDNO:84   -SILLPLIIGLVLLGLLALVLIAFCIVRRRPSAYQAL   354
SEQIDNO:85   -SLLLPLIIGLVLLGLLTLVLIAFCVTRRRQSTYQPL   330
SEQIDNO:86   -FNLLPLIVGVISLGLLALALVTFCIIRRRPPTYQPL   329
SEQIDNO:87   -SILLPLIIGLILLGLFALVLITFCVIRRRPPTYQAL   322
SEQIDNO:88   PSILVPLIIGLILVGLLALVLVAFCIARRRPSAYQAL   305
SEQIDNO:89   -TILLPLIIGLIFLGLLILVLVTFCIIRRRPPAYQPL   291
SEQIDNO:90   -SILLPLIIGLVLLGLLALVLIAFCIVRRRPSAYQAL   354
SEQIDNO:91   -NILVPLVVGLVLLTLLILVLSAFCISRRRPPAYQPL   323
SEQIDNO:92   -------------------------------------   263
```

| | Macrosailin | | | | |
|---|---|---|---|---|---|
| Accession No. | Species | SEQ ID NO: | Accession No. | Species | SEQ ID NO: |
| NP_001242.2 | *H. sapiens* | 80 | XP_849733.1 | *C. lupus familiaris* | 86 |
| XP_003315403.1 | *P. troglodytes* | 81 | NP_001093232.1 | *E. caballus* | 87 |
| NP_001039367.1 | *B. taurus* | 82 | XP_002719034.1 | *O. aries* | 88 |
| BAA23738.1 | *M. musculus* | 83 | XP_003131995.1 | *S. scrofa* | 89 |
| XP_014974003.1 | *M. mulatta* | 84 | XP_003912313.1 | *P. anubis* | 90 |
| NP_001026808.1 | *R. norvegicus* | 85 | XP_001369761.1 | *M. domestica* | 91 |
| | | | XP_001517723.2 | *O. anatinus* | 92 |

FIG. 9 (cont.)

HUMAN LAMP5 ALIGNMENT WITH ORTHOLOGOUS SEQUENCES

```
                      SIGNAL SEQUENCE        LAMP HOMOLOGY DOMAIN
                                                      1
SEQIDNO:93   MDLQGRGVPSIDRLRVLLMLFHTMAQIMAEQEVENLSGLSTNPEKDIFVVRENGTTCLMA 60
SEQIDNO:94   MDLRGRAVPSIDRLRVLLMLFHTMAQIMAEQEVENLSGLSTNPEKDIFVVRENGTTCLMA 60
SEQIDNO:95   MDLQGRAVPSVDRLRVLLMLFHTMAQIMAEQEVENLSGLSTNPEKDIFVVRENGTTCLMA 60
SEQIDNO:96   MDLRGRAFPSVYRLRVLLMLFYTMARITAEQEVENLSGLSTNPEKDIFVVRENGTTCLMA 60
SEQIDNO:97   MDLRRRALLGVDGLRVLLMLFHTVTRIMAEQEVENLSGLSTNPEKDIFVVRENGTTCLMA 60
SEQIDNO:98   MDLRVRTLLGGDRLRILLMFFHVMVQTVAEQEVENLSGLSTNPEKDIFVVRENGTTCLMA 60
SEQIDNO:99   MDLRGRALLGGDRLRILLMFFHAMAQTVAEQEVENLSGLSTNPEKDIFVVRENGTTCLMA 60
SEQIDNO:100  --------MAAGRLPGLLFLLHAAARLAAEQEVENLSGLSPNPEKDIFVVRENRTTCLMA 52
SEQIDNO:101  --MDYRACTSALRMPVLLLLLCTFSCNLAEQEVENLSGLSSNPDKNIFAIRENGTTCLMA 58
                      :  **:::  .      ************ **:*:**.:*** ******
```

```
                                LAMP HOMOLOGY DOMAIN
                                         2
SEQIDNO:93   EFAAKFIVPYDVWASNYVDLITEQADIALTRGAEVKGRCGHSQSELQVFWVDRAYALKML 120
SEQIDNO:94   EFAAKFIVPYDVWASNYVDLITEQADIALTRGAEVKGRCGHSESELQVFWVDRAYALKML 120
SEQIDNO:95   EFAAKFIVPYDVWASNYVDLITEQADIALTRGAEVKGRCGHSESELQVFWVDRAYALKML 120
SEQIDNO:96   EFAAKFIVPYDVWASNYVDLITEQADISLTRGAEVKGHCGHNESELQVFWVDRAYALKML 120
SEQIDNO:97   EFAAKFIVPYDVWASNYVDLITEQADISLTRGAEVKGHCGHDESELQVFWVDRAYALKML 120
SEQIDNO:98   EFAAKFIVPYDVWASNYVDLITEQAEISLTRGAEVKGHCGHNESELEVFWVDHAYTLRML 120
SEQIDNO:99   EFAAKFIVPYDVWASNYVDLITEQAEISLTRGAEVKGRCGHNESELQVFWVDRAYTLKML 120
SEQIDNO:100  EFAAKFVVPYDVWASNYVDLITEQADIPLSRGAEMKGKCGTNESELEISWLERAYTLKLF 112
SEQIDNO:101  EFSARILVPYEVPSSNEVDWDLEEASIQLPRDTEIRGKCWNNESELHLSWLDKAYTLKLF 118
             **:*::;***:*  :** **    *:*.* * *.:*::*:*   .:***.:  *:::**:*:::
```

```
                                LAMP HOMOLOGY DOMAIN

SEQIDNO:93   FVK-------------------------------ESHNMSKGPEATWRLSKVQFVYDSSEKTHF 153
SEQIDNO:94   FVK-------------------------------ESHNMSKGPEATWRLSKVQFVYDSSEKTHF 153
SEQIDNO:95   FVK-------------------------------ESHNTSKGPEATWRLSKVQFVYDSSEKTHF 153
SEQIDNO:96   FVK-------------------------------ESRNASKGPEATWRLSKVQFVYDSSEKTHF 153
SEQIDNO:97   FLK-------------------------------ESHNTPKGPEATWKLSKVQFVYDSSEKTHF 153
SEQIDNO:98   FVK-------------------------------ESHNTSKGPEATWNLNKVHFVYDSSEKTHF 153
SEQIDNO:99   FVK-------------------------------ESHNTSKGLEATWKLSKVQFVYDSSEKTHF 153
SEQIDNO:100  FLKVRGCPRRLGRGRCAAALRGPDQPCPPQEGHNTSRGPEAFWRLSRIQFSYDTSERTYF 172
SEQIDNO:101  FSK-------------------------------EGQDA--SKSRSWKMSKIQFLYDPSEHTIF 149
             * *                                     *.::   .  *.:.:::* ** **:* *
```

FIG. 10

```
                         LAMP HOMOLOGY DOMAIN
                                  3
SEQIDNO:93   KDAVSAGKHTANSHHLSALVTPAGKSYECQAQQTISLASSDPQKTVTMILSAVHIQPFDI 213
SEQIDNO:94   KDAVSAGKHTANSHHLSALVTPAGKSYECQAQQTISLASSDLQKTVTMILSAVHIQPFDI 213
SEQIDNO:95   KDAVSAGKHTANSHHLSALVTPAGKSYECQAQQTISLASSDPQKMVTMILSAVHIQPFDI 213
SEQIDNO:96   KDAVSAGKHTANSHRLSALVTPAGKSYECQAQQSISLASSDPQKTVTMILSAVHIQPFDI 213
SEQIDNO:97   KDAVSAGKHTANSHHLSALVTPAGKSYECQAQQTISLASSDPQKTVTMILSAVHIQPFDI 213
SEQIDNO:98   KAPVKVNKYIASSHHLSALVTPAGMSYECQAQQTISLASSDPQKTVTMILSAVHIQPFDI 213
SEQIDNO:99   KDAVSAGKHTANSHHLSALVTPAGMSYECQAQQTISLASSDPQKTVTMILSAVHIQPFDI 213
SEQIDNO:100  KDAVSPGKHTASSHRLSALVTPAGKSYECQAQQTISLISSDHQKSVQLLLSEVRIQPFDI 232
SEQIDNO:101  KSGARPGRHTANSHHLSLMVTPAGMSYECEATQRISLTSDHQKIVVLYLSEVHLQPFDI  209
              *   . .::  *.**:**  :*****  ****.*  *  *** *;* ** * : ** *::*****

Trans. Domain        Cyto Tail
                                    4
SEQIDNO:93   ISDFVFSEEHKCPVDEREQLEETLPLILGLILGLVIMVTLAIYHVHHKMTANQVQIPRDR 273
SEQIDNO:94   ISDFVFSEEHKCPVDEREQLEETLPLILGLILGLVIMVTLAIYHVHHKMTANQVQIPRDR 273
SEQIDNO:95   ISDFVFSEEHKCPVDEREQLEETLPLILGLILGLVIVVTLTIYHVHHKMTANQVQIPRDR 273
SEQIDNO:96   ISDFVFSEEHKCPVDEREQLEETLPLILGLILGLVIVVTLAIYHIHHKMTANQVQIPRDR 273
SEQIDNO:97   ISDFVFSEEHKCPVDEREQLEETLPLILGLILGLVIVVTLVIYHIHHKMTANQVQIPRDR 273
SEQIDNO:98   ISDFVFSEEHKCPVDEQEQLEETLPLILGLILGLVIVITLVIYHIHHKMTANQVQIPRDR 273
SEQIDNO:99   ISDFVFSEEHKCPVDEREQLEETLPLILGLILGLVIVITLVIYHIHHKMTANQVQIPRDR 273
SEQIDNO:100  TADFVFSEEHKCPVDQREQLEETLPLILGLILGLVIVITLCVYHIHHKLTANQVQIPRDR 292
SEQIDNO:101  KSDFVYSEEYKCPTDQRKQLEETLPLILGLTLGVAILIIVAVYHIHHKMTANQVQIPRDR 269
              :***:***.***.*::************ **:.*:: :  :**:***:**********

SEQIDNO:93   SQYKHMG 280
SEQIDNO:94   SQYKHMG 280
SEQIDNO:95   SQYKHMG 280
SEQIDNO:96   SQYKHMG 280
SEQIDNO:97   SQYKHMG 280
SEQIDNO:98   SQYKHMG 280
SEQIDNO:99   SQYKHMG 280
SEQIDNO:100  SQYKHMG 299
SEQIDNO:101  SLYKHMG 276
              * *****
```

| LAMP5 | | | | | |
|---|---|---|---|---|---|
| Accession No. | Species | SEQ ID NO: | Accession No. | Species | SEQ ID NO: |
| NP_036393.1 | *H. sapiens* | 93 | NP_001076887.1 | *B. taurus* | 97 |
| XP_514512.3 | *P. troglodytes* | 94 | NP_083806.2 | *M. musculus* | 98 |
| NP_001181627.1 | *M. mulatta* | 95 | NP_001014205.1 | *R. norvegicus* | 99 |
| XP_850634.1 | *C. lupus familiaris* | 96 | XP_004935300.1 | *G. gallus* | 100 |
|  |  |  | NP_001090781.1 | *X. tropicalis* | 101 |

FIG. 10 (cont.)

SEQ ID NO:115 Cor a 1 amino acids(1-159)

MGVFCYEDEATSVIPPARLFKSFVLDADNLIPKVAPQHFTSAENLEGNGGPGTIKKITFAEGNEFKYMKHKVE
EIDHANFKYCYSIIEGGPLGHTLEKISYEIKMAAAPHGGGSILKITSKYHTKGNASINEEEIKAGKEKAAGLF
KAVEAYLLAHPDAY

Polynucleotide sequence encoding Cor a 1(flanking XhoI-EcoRI uppercase)(SEQ ID NO:114)

CTCGAGatgggcgtgttctgctacgaggacgaggccacaagcgtgatccctcccgccagactgttcaagagct
cgtgctggacgccgacaatctgatccccaaagtggcccccagcacttcaccagcgccgagaatctggaagg
caatggcggacccggcaccatcaagaagatcacattcgccgagggcaacgagttcaagtacatgaagcacaaa
gtggaagagatcgaccacgccaacttcaagtactgctacagcatcatcgaaggcggccctctgggccacacac
tggaaaagatcagctacgagatcaagatggccgctgcccctcacggcggaggcagcattctgaagatcaccag
caagtaccacaccaagggcaacgccagcatcaacgaggaagaaatcaaggccggcaaagagaaagccgcgga
ctgtttaaggccgtggaagcctatctgctggcccaccccgatgcctacGAATTC

SEQ ID NO:117 Cor a 9 amino acids (24-320)

INVGLRRQQQRYFGECNLDRLNALEPTNRIEAEACQIESWDHNDQQFQCAGVAVIRRTIEPNGLLLPQYSNAP
ELIYIERGRGITGVLFPGCPETFEDPQQQSQQGQRQGQGQSQRSEQDRHQKIRHFREGDIIALPAGVAHWCYN
DGDSPVVTVSLLHTNNYANQLDENPRHFYLAGNPDDEHQRQGQQQFGQRRRQQQHSHGEQGEQEQQGEGNNVF
SGFDAEFLADAFNVDVDTARRLQSNQDKRRNIVKVEGRLQVVRPERSRQEWERQERQERESEQERERQRRQGG
RGRDVN

Polynucleotide encoding Cor a 9 (revised)(flanking XhoI-EcoRI uppercase) (SEQ ID NO:116)

CTCGAGatcaacgtgggactgcggagacagcagcagcggtacttcggcgagtgcaatctggaccggctgaacg
ctctggaacccaccaacagaatcgaggccgaggcttgccagatcgagagctgggaccacaacgaccagcagtt
ccagtgtgctggcgtggccgtgatcagacggaccatcgagcccaacggactgctgctgccccagtacagcaat
gcccccgagctgatctacatcgagcggggcagaggaatcaccggcgtgctgtttcccggctgccccgagacat
tcgaggaccctcagcagcagagccagcaaggccagagacaaggccaaggccagtcccagagaagcgagcaaga
ccggcaccagaagatccggcacttcagagagggcgacatcattgctctgccagccggcgtggcccactggtgc
tacaatgatggcgatagccccgtcgtgaccgtgtctctgctgcacaccaacaactacgccaaccagctggacg
agaaccccagacacttctatctggccggcaaccccgacgacgagcaccagaggcaagggcagcagcagttcgg
ccagagaagaaggcagcagcagcacagccatggcgagcaaggcgagcaagagcagcaaggcgagggcaacaac
gtgttcagcggcttcgacgccgagtttctggccgacgccttcaacgtggacgtggacacagccagacggctgc
agtccaaccaagacaagcggcggaacatcgtgaaagtggaaggccggctccaagtcgtgcggcccgagagatc
tagacaagagtgggagcggcaagagcggcaagaacgcgagagcgagcaagagagagagcggcagagaaggcaa
ggcggcagaggcagagatgtgaacGAATTC

SEQ ID NO:119 Cor a 1-Gly 4-Cor a 9 amino acids

MGVFCYEDEATSVIPPARLFKSFVLDADNLIPKVAPQHFTSAENLEGNGGPGTIKKITFAEGNEFKYMKHKVE
EIDHANFKYCYSIIEGGPLGHTLEKISYEIKMAAAPHGGGSILKITSKYHTKGNASINEEEIKAGKEKAAGLF
KAVEAYLLAHPDAY<u>GGGG</u>INVGLRRQQQRYFGECNLDRLNALEPTNRIEAEACQIESWDHNDQQFQCAGVAVI
RRTIEPNGLLLPQYSNAPELIYIERGRGITGVLFPGCPETFEDPQQQSQQGQRQGQGQSQRSEQDRHQKIRHF
REGDIIALPAGVAHWCYNDGDSPVVTVSLLHTNNYANQLDENPRHFYLAGNPDDEHQRQGQQQFGQRRRQQQH
SHGEQGEQEQQGEGNNVFSGFDAEFLADAFNVDVDTARRLQSNQDKRRNIVKVEGRLQVVRPERSRQEWERQE
RQERESEQERERQRRQGGRGRDVN

FIG. 14

Polynucleotide encoding Cor a 1-GLY4-Cor a 9 (SEQ ID NO:118)(XhoI-EcoRI and Gly4 linker uppercase)

CATATGCTCGAGatgggcgtgttctgctacgaggacgaggccacaagcgtgatcctcccgccagactgttca
agagcttcgtgctggacgccgacaatctgattcccaaagtggcccccagcacttcaccagcgccgagaatct
ggaaggcaatggcggaccggcatcatcaagaagatcacattcgccgagggcaacgagttcaagtacatgaag
cacaaagtggaagagatcgaccacgccaacttcaagtactgctacagcatcatcgaaggcggccctctgggc
atacactggaaaagatcagctacgagatcaagatggccgctgccatcacggcggaggcagcattctgaagat
cacccagcaagtaccacaccaagggcaacgccagcatcaacgaggaagaaatcaaggccggcaaagagaagc
gccggactgttaaggccgtggaagcctatctgctggccacccgatgcctacGGCGGAGGGGGCatcaacg
tgggactgcggagacagcagcagcggtacttcggcgagtgcaatctggaccggctgaacgctctggaacccac
caacagaatcgaggccgaggcttgccagatcgagagctgggaccacaacgaccagcagttccagtgtgctggc
gtggccgtgatcagacggaccatcgagcccaacggactgctgctgccccagtacagcaatgccccgagctga
tctacatcgagcggggcagaggaatcaccggcgtgctgtttcccggctgccccgagacattcgaggaccctca
gcagcagagccagcaaggccagagacaaggccaaggccagtcccagagaagcgagcaagaccggcaccagaag
atccggcacttcagagagggcgacatcattgctctgccagccggcgtggcccactggtgctacaatgatggcg
atagccccgtcgtgaccgtgtctctgctgcacaccaacaactacgccaaccagctggacgagaaccccagaca
cttctatctggccggcaaccccgacgacgagcaccagaggcaagggcagcagcagttcggccagagaagaagg
cagcagcagcacagccatggcgagcaaggcgagcaagagcagcaaggcgagggcaacaacgtgttcagcggct
tcgacgccgagtttctggccgacgccttcaacgtggacgtggacacagccagacggctgcagtccaaccaaga
caagcggcggaacatcgtgaaagtggaaggccggctccaagtcgtgcggcccgagagatctagacaagagtgg
gagcggcaagagcggcaagaacgcgagagcgagcaagagagagagcggcagagaaggcaaggcggcagaggca
gagatgtgaacGAATTCGTCGAC SEQ ID NO:121 Pru du 6 amino acids (26-272)

ARQSQLSPQNQCQLNQLQAREPDNRIQAEAGQIETWNFNQEDFQCAGVAASRITIQRNGLHLPSYSNAPQLIY
IVQGRGVLGAVFSGCPETFEESQQSSQQGRQQEQEQERQQQQQGEQGRQQGQQEQQQERQGRQQGRQQEEGR
QQEQQQGQQGRPQQQQQFRQFDRHQKTRRIREGDVVAIPAGVAYWSYNDGDQELVAVNLFHVSSDHNQLDQNP
RKFYLAGNPENEFNQQGQSQPRQQGEQGRPGQHQQPFGRPRQQEQQGSGNNVFSGFNTQLLAQALNVNEETAR
NLQGQNDNRNQIIRVRGNLDFVQPPRGRQEREHEERQQEQLQQERQQQGGQLMAN

Polynucleotide encoding Pru du 6 (SEQ ID NO:120) (flanking XhoI-EcoRI-uppercase)

CTCGAGgccagacagagccagctgagcccccagaatcagtgccagctgaaccagctgcaagccagagagcccg
acaaccggattcaagccgaggccggccagatcgagacatggaacttcaaccaagaggacttccagtgtgccgg
cgtggccgccagcagaatcaccatccagcggaacggactgcatctgcccagctacagcaacgccccccagctg
atctacatcgtgcaaggcagaggcgtgctgggcgccgtgtttagcggatgccccgagacattcgaggaaagcc
agcagagcagccagcaaggccggcagcaagagcaagaacaagagagacaacagcagcagcaagggagcaagg
cagacagcaaggacagcaagagcagcagcaagagcgccaaggacggcagcaagggcgccagcagcaagaagag
ggcagacagcaagaacagcagcaaggccagcaaggcggcctcagcagcagcagcagttccggcagttcgacc
ggcaccagaaaacccggcggatcagagaaggcgacgtggtggctattccagccggggtggcctactggtccta
caacgacggcgaccaagaactggtggccgtgaatctgttccacgtgtccagcgaccacaaccagctggaccag
aaccccggaagttctatctggctggcaaccccgagaacgagttcaaccagcaaggcagagccagcccagac
agcaaggcgaacaaggacggcccggacagcaccagcagcctttcggcagaccacggcagcaagagcagcaagg
cagcggcaacaacgtgttcagcggcttcaacacccagctgctggcccaagctctgaacgtgaacgaggaaacc
gcccggaatctgcaaggccagaacgacaacagaaaccagatcatcagagtgcggggcaatctggacttcgtgc
agccccctagaggcggcaagagagagagcacgaagagagagcaagaacagcagctgcagcaagagcggcagca
gcaaggcggacagctgatggccaacGAATTC SEQ ID NO:123 Ana o 1 amino acids (27-538)

KIDPELKQCKHQCKVQRQYDEQQKEQCVKECEKYYKEKKGREREHEEEEEEWGTGGVDEPSTHEPAEKHLSQC
MRQCERQEGGQQKQLCRFRCQERYKKERGQHNYKREDDEDEDEDEAEEEDENPYVFEDEDFTTKVKTEQGKVV
LLPKFTQKSKLLHALEKYRLAVLVANPQAFVVPSHMDADSIFFVSWGRGTITKILENKRESINVRQGDIVSIS
SGTPFYIANNDENEKLYLVQFLRPVNLPGHFEVFHGPGGENPESFYRAFSWEILEAALKTSKDTLEKLFEKQD
QGTIMKASKEQIRAMSRRGEGPKIWPFTEESTGSFKLFKKDPSQSNKYGQLFEAERIDYPPLEKLDMVVSYAN
ITKGGMSVPFYNSRATKIAIVVSGEGCVEIACPHLSSSKSSHPSYKKLRARIRKDTVFIVPAGHPFATVASGN
ENLEIVCFEVNAEGNIRYTLAGKKNIIKVMEKEAKELAFKMEGEEVDKVFGKQDEEFFFQGPEWRKEKEGRAD
E

Polynucleotide encoding Ana o 1 (SEQ ID NO:122) (flanking XhoI-EcoRI uppercase)

CTCGAGaagatcgaccccgagctgaagcagtgcaagcaccagtgcaaagtgcagcggcagtacgacgagcagc
agaaagaacagtgcgtgaaagagtgcgagaagtactacaaagagaagaagggccgcgagcgcgagcacgaaga
ggaagaggaagaatggggcaccggcggagtggacgagccttctacacacgagcccgccgagaaacatctgagc
cagtgcatgagacagtgcgaacggcaagagggcggccagcagaaacagctgtgccggttccggtgccaagagc
ggtacaagaaagagcggggccagcacaactacaagagagaggacgacgaggacgaagatgaggacgaggctga
ggaagaggacgagaacccctacgtgttcgaggatgaggacttcaccaccaaagtgaaaaccgagcaaggcaaa
gtggtgctgctgcccaagttcacccagaagtccaagctgctgcacgctctggaaaagtaccggctggccgttc
tggtggccaaccctcaagccttcgtggtgccagccacatggacgccgacagcatcttcttcgtgtcttggg
cagaggcaccatcaccaagattctggaaaacaagcgcgagagcatcaacgtgcggcaaggcgacatcgtgtcc
atcagcagcggcacccccttctacattgccaacaacgacgagaacgagaagctgtatctggtgcagtttctgc
ggcccgtgaatctgccggccactttgaagtgttccacggacccggcggagagaaccccgagagcttctacag
agccttcagctgggaaattctggaagccgctctgaaaacatccaaggacacactggaaaagctgttcgagaag
caagaccaagggaccatcatgaaggccagcaaagaacagatccgggccatgagcagaagaggcgagggcccca
agatctggcccttcaccgaggaaagcaccggcagcttcaagctgtttaagaaggaccccagccagagcaacaa
atacggcagctgtttgaggccgagcggatcgactaccccccactggaaaagctggacatggtggtgtcctac
gccaatatcaccaagggcggcatgagcgtgcccttttacaacagcagagccaccaagatcgccatcgtggtgt
ccggcgagggctgcgtggaaatcgcttgccctcatctgagcagcagcaagtccagccaccccagctacaagaa
gctgcgggccagaatccggaaggacaccgtgttcatcgtgccagccggccaccctttgccacagtggccagc
ggcaacgagaatctggaaatcgtgtgcttcgaagtgaacgccgagggcaacatccggtacacactggccggca
agaagaacatcatcaaagtgatggaaaaggaagccaaagaactggcctttaagatggaaggcgaggaagtgga
caaagtgttcggcaagcaagatgaagagttcttctttcaaggccccgagtggcgcaaagagaagagggcaga
gccgacgagGAATTC

SEQ ID NO:125 Ana o 2 amino acids (1-457)

LSVCFLILFHGCLASRQEWQQQDECQIDRLDALEPDNRVEYEAGTVEAWDPNHEQFRCAGVALVRHTIQPNGL
LLPQYSNAPQLIYVVQGEGMTGISYPGCPETYQAPQQGRQQGQSGRFQDRHQKIRRFRRGDIIAIPAGVAHWC
YNEGNSPVVTVLLDVSNSQNQLDRTPRKFHLAGNPKDVFQQQQQHQSRGRNLFSGFDTELLAEAFQVDERLI
KQLKSEDNRGGIVKVKDDELRVIRPSRSQSERGSESEEESEDEKRRWGQRDNGIEETICTMRLKENINDPARA
DIYTPEVGRLTTLNSLNLPILKWLQLSVEKGVLYKNALVLPHWNLNSHSIIYGCKGKGQVQVVDNFGNRVFDG
EVREGQMLVVPQNFAVVKRAREERFEWISFKTNDRAMTSPLAGRTSVLGGMPEEVLANAFQISREDARKIKFN
NQQTTLTSGESSHHMRDDA

Polynucleotide encoding Ana o 2 (SEQ ID NO:124) (flanking XhoI-EcoRI uppercase)

CTCGAGctgagcgtgtgctttctgattctgttccacggctgtctggccagccggcaagaatggcagcagcaag
acgagtgccagatcgaccggctggacgctctggaacccgacaaccgggtggaatacgaggccggcacagtgga
agcttgggaccccaaccacgagcagttcagatgtgccggcgtggcactcgtgcggcacaccatccagccaaac
ggactgctgctgccccagtacagcaacgccccccagctgatctatgtggtgcaaggcgagggcatgaccggca

FIG. 14 (cont.)

```
tcagctatcccggctgccccgagacatatcaagcccctcagcaaggcagacagcaaggccagagcggccggtt
ccaagaccggcaccagaagatccggcggttcagacggggcgacatcattgccattccagccggggtggcccac
tggtgctacaacgagggcaatagccccgtcgtgaccgtgacactgctggacgtgtccaacagccagaaccagc
tggaccggaccccccggaagtttcatctggccggcaaccccaaggacgtgttccagcaacagcagcagcacca
gagccgggggcagaaatctgttcagcggcttcgacaccgagctgctggccgaggcttttcaagtggacgagcgg
ctgatcaagcagctgaagtccgaggacaacagaggcggcatcgtgaaagtgaaggacgacgagctgagagtga
tccggcccagcagaagccagagcgagagaggcagcgagagcgaggaagagtctgaggacgagaagcggagatg
gggccagcgggacaacggcatcgaagagacaatctgcaccatgcggctgaaagagaacatcaacgaccccgcc
agagccgacatctacacccccgaagtgggccggctgacaactctgaactctctgaatctgcccattctgaagt
ggctgcagctgtccgtggaaaagggggtgctgtacaagaacgctctggtgctgcctcactggaatctgaacag
ccacagcatcatctacggctgcaagggcaagggccaagtccaagtggtggacaacttcggcaacagagtgttc
gacggcgaagtgcgcgagggccagatgctcgtggtgccccagaatttcgccgtcgtgaagcgggccagagaag
aaagattcgagtggatcagcttcaagaccaacgaccgggccatgaccagccctctggccggaagaacatctgt
gctgggcggcatgcccgaggaagtgctggctaacgccttccagatcagcagagaggacgcccggaagatcaag
ttcaacaaccagcagaccacactgaccagcggcgagagcagccaccacatgagagatgacgccGAATTC
```

SEQ ID NO:127 Ana o 3 amino acids (21-138)

SIYRAIVEVEEDSGREQSCQRQFEEQQRFRNCQRYVKQEVQRGGRYNQRQESLRECCQELQEVDRRCRCQNLE
QMVRQLQQQEQIKGEEVRELYETASELPRICSISPSQGCQFQSSY

Polynucleotide encoding Ana o 3 (SEQ ID NO:126)(flanking XhoI-EcoRI uppercase)

```
CTCGAGagcatctaccgggccatcgtggaagtggaagaggacagcggcagagagcagagctgccagcggcagt
tcgaggaacagcagcggttcagaaactgccagagatacgtgaagcaagaagtgcagagaggcggcagatacaa
ccagagacaagagtctctgagagagtgctgccaagagctgcaagaagtggaccggcgctgccggtgccagaat
ctggaacagatggtgcgccagctgcagcagcaagagcagatcaagggcgaggaagtgcgcgagctgtacgaga
cagccagcgagctgcctcggatctgcagcatcagcccaagccaaggctgccagttccagagcagctacGAATT
C
```

SEQ ID NO:129 Ana o 2-Gly4-Ana o 1-Gly4-Ana o 3 amino acids

LSVCFLLLFHGCLASRQEWQQQDECQIDRLDALEPDNRVEYEAGTVEAWDPNHEQFRCAGVALVRHTIQPNGL
LLPQYSNAPQLIYVVQGEGMTGISYPGCPETYQAPQQGRQQGQSGREQDRHQKIRRFRRGDIIAIPAGVAHWC
YNEGNSPVVTVTLLDVSNSQNQLDRTPRKFHLAGNPKDVPQQQQHQSRGRNLFSGFDTELLAEAFQVDERLI
KQLKSEDNRGGIVKVKDDELRVIRPSRSQSERGSESEEESEDERKRWGQRDNGIEETICTMRLKENINDPARA
DIYTPEVGRLTTLNSLNLPILKWLQLSVEKGVLYKNALVLPHWNLNSHSIIYGCKGKGQVQVVDNFGNRVFDG
EVREGQMLVVPQNFAVKKAREERFEWISFKTNDRAMTSPLAGRTSVLGGMPEEVLANAFQISREDARKIKFN
NQQTTLTSGESSHHMRDDA*GGGG*KIDPELKQCRHQCVQRQYDEQQKEQCVKECEKYYKEKKGREREHEEEE
EEWGTGGVDEPSTHEPAEKHLSQCMRQCERQEGGQQKQLCRFRCQERYKKERGQHNYKREDDEDEDEDEAEEE
DENPYVEEDEDFTTKVKTEQGKVVLLPKFTQKSKLLHALEKYRLAVLVANPQAFVVPSHMDADSIFFVSWGRG
TITKILENKRESINVRQGDIVSISSGTPFYIANNDENEKLYLVQFLRPVNLPGHFEVFHGPGGENPESFYRAF
SWEILEAALKTSKDTLEKLFEKQDQGTIMKASKEQIRAMSRRGEGPKIWPFTEESTGSFKLFKKDPSQSNKYC
QLFEAERIDYPPLEKLDMVVSYANITKGGMSVPFYNSRATKIAIVVSGEGCVEIACPHLSSSKSSHPSYKKLR
ARIRKDTVFIVPAGHPFATVASGNENLEIVCFEVNAEGNIRYTLAGKKNIIKVMEKEAKELAFKMEGEEVDKV
FGKQDEEFFFQGPEWRKEKEGRADE*GGGG*SIYRAIVEVEEDSGREQSCQRQFEEQQRFRNCQRYVKQEVQRG
GRYNQRQESLRECCQELQEVDRRCRCQNLEQMVRQLQQQEQIKGEEVRELYETASELPRICSISPSQGCQFQS
SY

Polynucleotide encoding Ana O 2-Gly4-Ana O 1-Gly4-Ana O 3(SEQ ID NO:128)

CTCGAGctgagcgtgtgcttttctgattctgttccacggctgtctggccagccggcaagaatggcagcagcaag
acgagtgccagatcgaccggctggacgctctggaacccgacaaccgggtggaatacgaggccggcacagtgga
agcttgggaccccaaccacgagcagttcagatgtgccggcgtggcactcgtgcggcacaccatccagccaaac
ggactgctgctgcccagtacagcaagccccccagctgatctatgtggtgcaaggcgagggcatgaccggca
ttagctatccggctgctcccgagacatatcaagcccctcagcaaggcagacagcaaggccagagcggccggtt
ccaagaccggcaccagaagatccggccgttcagacggggcgacatcattgccattccagccggggtggcccac
tggtgctacaacgagggcaatagcccgtcgtgaccgtgacactgctggacgtgtccaacagccagaaccagc
tggaccggaccccccggaagtttcatctggccggcaacccgaaggacgtgttccagcaacagcagcagcacca
gagccggggcagaaatctgttcagcggcttcgacaccgagctgtctggccgaggctttttcaagtggacgagcgg
ctgatcaagcagctgaagtccgaggacaacagaggcggcatcgtgaaagtgaaggacgacgagctgagagtga
tccggccagcagaagccagagctgagagaggcagcgagagcgaggaagagtctgaggacgagaagcggagatg
gggccagcgggacaacggcatcgaagagacaatctgcaccatgcggctgaaagagaacatcaacgacccgct
agagccgacatctacaccccgaagtggccggctgacaattctgaactctctgaatctgccattctgaagt
ggctgcagctgtccgtggaaaagggtcgtgtacaagaacgttctggtgctgcctcattggaatctgaacag
ccacagcatcatctacggctgcaagggcaagggccaagtccaagtggtggacaacttcggcaacagagtgttc
gacggcgaagtgcgcgaggcccagatcgtcgtggtgcccagaatttcgccgtcgtgaagcgggccagagaag
aaagatcgagtggatcagcttcaagaccaacgaccggcatgaccagccctctggccggaagaacatctgt
gctgggcggcatgccgaggaagtgctgctaacgccttcagatcagcagagaggacgccggaagatcaag
ttcaacaaccagcagaccacactgaccagcggcgagagcagccaccacatgagagatgacgccGGCGGAGGGG
GCaagatcgaccccgagctgaagcagtgcaagcaccagtgcaaagtgcagcggcagtacgacgagcagcagaa
agaacagtgcgtgaaagagtgcgagaagtactacaaagagaagaagggccgcgagcgcgagcacgaagaggaa
gaggaagaatggggcaccggcggagtggacgagccttctacacacgagcccgccgagaaacatctgagccagt
gcatgagacagtgcgaacggcaagagggcggccagcagaaacagctgtgccggttccggtgccaagagcggta
caagaaagagcggggccagcacaactacaagagagaggacgacgaggacgaagatgaggacgaggctgaggaa
gaggacgagaacccctacgtgttcgaggatgaggacttcaccaccaaagtgaaaaccgagcaaggcaaagtgg
tgctgctgcccaagttcacccagaagtccaagctgctgcacgctctggaaaagtaccggctggccgttctggt
ggccaaccctcaagccttcgtggtgcccagccatggacgccgacagcatcttcttcgtgtcttggggcaga
ggcaccatcaccaagattctggaaaacaagcgcgagagcatcaacgtgcggcaaggcgacatcgtgtccatca
gcagcggcaccccttctacattgccaacaacgacgagaacgagaagctgtatctggtgcagtttctgcggcc
cgtgaatctgcccggccactttgaagtgttccacggacccggcggagagaaccccgagagcttctacagagc
ttcagctgggaaattctggaagccgctctgaaaacatccaaggacacactggaaaagctgttcgagaagcaag
accaagggaccatcatgaaggccagcaaagaacagatccggggccatgagcagaagaggcgagggccccaagat
ctggcccttcaccgaggaaaacaccggcagcttcaagctgtgtttaagaaggaccccagccagagcaacaaatac
gggcagctgttgaggccgagcggatcgactaccccccactggaaaagctggacatggtggtgtcctacgcca
atatcaccaagggcggcatgagcgtgcccttttacaacagcagagccaccaagatcgccatcgtggtgtccgg
cgagggctgcgtggaaatcgcttgccctcatctgagcagcagcaagtccagccaccccagctacaagagctg
cgggccagaatccggaaggacaccgtgttcatcgtgccagccggccaccttttgccacagtggccagcggca
acgagaatctggaaatcgtgtgcttcgaagtgaacgccgagggcaacatccggtacacactggccggcaagaa
gaacatcatcaaagtgatggaaaaggaagccaaagaactggcctttaagatggaaggcgaggaagtggacaaa
gtgttcggcaagcaagatgaagagttcttcttcaggcccgagtggcgcaaagagaaagagggcagagccg
acgagGGCGGAGGGGGCagcatctaccgggccatcgtggaagtggaagaggacagcggcagagagcagagctg
ccagcggcagttcgaggaacagcagcggttcagaaactgccagagatacgtgaagcaagaagtgcagagaggc
ggcagatacaaccagagacaagagtctctgagagagtgctgccaagagctgcaagaagtggaccggcgctgcc
ggtgccagaatctggaacagatggtgcgccagctgcagcagaagagcagatcaagggcgaggaagtgcgcga
gctgtacgagacagccagcgagctgcctcggatctgcagcatcagcccaagccaaggctgccagttccagagc
agctacGAATTC SEQ ID NO:131 Jug n 1 amino acids (39-161)

RTTITTMEIDEDIDNPRRGEGCQEQIQRQQNLNHCQYYLRQQSRSGGYDEDNQRQHFRQCCQQLSQIEEQCQ
CEGLRQAVRRQQQQQGLRGEEMEEMVQSARDLPKECGISSQRCEIRRSWF

Polynucleotide encoding Jug n 1(SEQ ID NO:130) (flanking XhoI-EcoRI uppercase)

CTCGAGcggaccaccatcaccaccatggaaatcgacgaggacatcgacaaccccagaagaagaggcgagggct
gccaagagcagatccagcggcagcagaatctgaaccactgccagtactatctgaggcagcagagcagaagcgg
cggctacgacgaggataaccagagacagcacttcagacagtgctgccagcagctgagccagatcgaggaacag
tgccagtgcgagggactgagacaagccgtgcggagacaacagcagcagcaaggactgcggggcgaagagatgg
aagaaatggtgcagagcgccagagatctgcccaaagagtgcggcatcagcagccagagatgcgagatccggcg
gagttggttcGAATTC

SEQ ID NO: 133 Jug r 2 amino acids (1-593)

RGRDDDDEENPRDPREQYRQCQEYCRRQGQGQRQQQQCQIRCEERLEEDQRSQEERERRGRDVDDQNPRDPE
QRYEQCQQQCERQRRGQEQTLCRRRCEQRRQQEERERQRGRDRQDPQQQYHRCQRRCQIQEQSPERQRQCQQR
CERQYKEQQGRERGPEASPRRESRGREEEQQRHNPYYFHSQSIRSRHESEEGEVKYLERFTERTELLRGIENY
RVVILDANPNTSMLPHHKDAESVAVVTRGRATLTLVSQETRESFNLECGDVIRVPAGATVYVINQDSNERLEM
VKLLQPVNNPGQFREYYAAGAKSPDQSYLRVFSNDILVAALNTPRDRLERFFDQQEQPREGVIIRASQEKLRAL
SQHAMSAGQRPWGRRSSGGPISLKSESPSYSNQFGQFFEACPEEHRQLQEMDVLVNYAEIKRGAMMVPHYNSK
ATVVVYVVEGTGRYEMACPHVSSQSYEGQGRREQEEEESTGRFQKVTARLARGDIFVIPAGHPIAITASQNEN
LRLLGFDINGENNQRDFLAGQNNIINQLEREAKELSFNMPREEIEEIFESQMESYFVPTERQSRRGQGRDHPL
ASILDFAFF

Polynucleotide encoding Jug r 2 (SEQ ID NO:132)(flanking XhoI-EcoRI uppercase)

CTCGAGagaggccgggacgacgacgatgaggaaaaccccagagatcccgcgagcagtaccggcagtgccaag
agtactgcagaaggcaaggccaaggccagagacagcagcagcagtgccagatcagatgcgaggaacggctgga
agaggaccagcggagccaagaggaacgcgagcggagaagaggcagagatgtggacgaccagaaccccccggga
cccgagcagagatacgagcagtgtcagcagcagtgtgaacggcagcggagaggccaagagcagacactgtgtc
ggcggagatgcgagcagcggcggcagcaagaggaaagagaacgccagcggggcagagacagacaagacccca
gcagcagtaccaccggtgccagagaagatgccagatccaagaacagagccccgagcggcagcgccagtgccag
cagagatgcgaagacagtacaaagagcagcaaggcagagagaggggcccagaggccagccctagaagagagt
ccagaggacgggaagaagaacagcagcggcacaacccctactacttccacagccagagcatcagaagccggca
cgagagcgaagagggcgaagtgaagtatctggaacggttcaccgagcggaccgagctgctgagaggcatcgag
aactaccgggtcgtgattctggacgccaaccccaacacatccatgctgccccaccacaaggacgccgagtctg
tggccgtcgtgacaaggggcagagccacactgacactggtgtcccaagagactcgcgagagcttcaatctgga
atgcggcgacgtgatccgggtgccagctggggctacagtgtacgtgatcaaccaagacagcaacgagcggctg
gaaatggtcaagctgctgcagcccgtgaacaaccccggccagttcagagagtactacgccgctggcgccaagt
cccccgaccagagctatctgcgggtgttcagcaacgacattctggtggccgctctgaataccctcgggacag
actggaaagattcttcgatcagcaagagcagcgcgagggcgtgatcatcagagccagccaagagaagctgcgg
gctctgagccagcacgccatgtctgctggacagaggccttggggcagaagaagctctggcggccctatctctc
tgaagtccgagagccctcctacagcaaccagtttggccagttcttcgaggcttgccccgaggaacaccggca
gctgcaagaaatggacgtgctcgtgaactacgccgagatcaagaggggcgccatgatggtgccccactacaac
agcaaggccaccgtggtggtgtacgtggtggaaggcaccggcagatacgagatggcatgccccacgtgtcca
gccagtcttacgagggccaaggacgcagagagcaagaagaggaagagtccaccggacggttccagaaagtgac
cgccagactggccagaggcgacatcttcgtgatcccagccggacaccctatcgccatcaccgccagccagaac
gagaatctgcggctgctgggcttcgacatcaacggcgagaacaaccagcgggactttctggccggacagaaca
acatcatcaaccagctggaacgggaagccaaagaactgagcttcaacatgcccgcgaggaaatcgaagagat tttcgagagccagatggaaagctacttcgtgcccaccgagcgccagagcagaagggcccaagggcgggatcac
ccactggcctctattctggatttcgccttcttcGAATTC

SEQ ID NO:135 Jug n 1-Gly4-Jug r 2 amino acids

RTTITTMEIDEDIDNPRRRGEGCQEQIQRQQNLNHCQYYLRQQSRSGGYDEDNQRQHFRQCCQQLSQIEEQCQ
CEGLRQAVRRQQQQGLRGEEMEEMVQSARDLPKECGISSQRCEIRRSWFGGGGRGRDDDDEENPRDPREQYR
QCQEYCRRQGQGQRQQQQCQIRCEERLEEDQRSQEERERRRGRDVDDQNPRDPEQRYEQCQQQCERQRRGQEQ
TLCRRRCEQRRQQEERERQRGRDRQDPQQQYHRCQRRCQIQEQSPERQRQCQQRCERQYKEQQGRERGPEASP
RRESRGREEEQQRHNPYYFHSQSIRSRHESEEGEVKYLERFTERTELLRGIENYRVVILDANPNTSMLPHHKD
AESVAVVTRGRATLTLVSQETRESFNLECGDVIRVPAGATVYVINQDSNERLEMVKLLQPVNNPGQFREYYAA
GAKSPDQSYLRVFSNDILVAALNTPRDRLERFFDQQEQREGVIIRASQEKLRALSQHAMSAGQRPWGRRSSGG
PISLKSESPSYSNQFGQFFEACPEEHRQLQEMDVLVNYAEIKRGAMMVPHYNSKATVVVYVVEGTGRYEMACP
HVSSQSYEGQGRREQEEEESTGRFQKVTARLARGDIFVIPAGHPIAITASQNENLRLLGFDINGENNQRDFLA
GQNNIINQLEREAKELSFNMPREEIEEIFESQMESYFVPTERQSRRGQGRDHPLASILDFAFF

Polynucleotide encoding Jug n 1-Gly4-Jug r 2 (flanking XhoI-EcoRI uppercase) (SEQ ID NO:134)

CTCGAGggaccaccatcaccaccatggaaatcgacgaggacatcgacaacccgagaagaagaggcgagggct
gccaagagcagatcagcggcagcagaatctgaaccactgcagtactatctgaggcagcagagcagaagcgg
cggctacgacgaggataaccagagacagcacttcagacagtgctgccagcagctgagccagatcgaggaaca
gtgccagtgtgagggactgagacaagccgtggtgagacaacagcagcagcaaggactgcgggcgaagagatgg
aagaaatggtgcagagcgccagagatctgcccaagagtgcggcatcagcagcagagatcgagatccggc
gagttggttcGGCGGAGGGGGCagaggccgggacgacgacgatgaggaaaacccagagatccccgcgagcag
taccggcagtgccaagagtactgcagaaggcaaggccaaggccagagacagcagcagcagtgccagatcagat
gcgaggaacggtgaagaggaccagcggagcagaggaacgcgagcggagaagaggcagagatgtggacga
ccagaaccccgggaccccgagcagagatacgagcagtgtcagcagcagtgtgaacggcagcggagaggccaa
gagcagacactgtgtcggcggagatgcgagcagcggcggcagcaagaggaaagagaacgccagcggggcagag
acagacaagacccccagcagcagtaccaccggtgccagagaagatgccagatccaagaacagagcccgagcg
gcagcgccagtgccagcagagatgcgaaagacagtacaaagagcagcaaggcagagagagggggcccagaggcc
agccctagaagagagtccagaggacgggaagaagaacagcagcggcacaacccctactactccacagccaga
gcatcagaagccggcacgagagccgaagagggcgaagtgaagtatctggaacggttcaccgagcggaccgagct
gctgagaggcatcgagaactaccgggtcgtgattctggacgccaacccaacacatccatgctgccccaccac
aaggacgccgagtctgtggccgtcgtgacaagggcagagccacactgacactggtgtcccagagactcgcg
agagcttcaatctggaatgcggcgacgtgatccgggtgccagctggggctacagtgtacgtgatcaaccaaga
cagcaacgagcggctggaaatggtcaagctgctgcagccgtgaacaacccggccagttcagagagtactac
gccgctggccgccaagtccccgaccagagctatctgcgggtgttcagcaacgacattctggtggccgctctga
atacccctcgggacagactggaaagattcttcgatcagcaagagcagcgagggcgtgatcatcagagccag
ccaagagaagctgcgggctctgagccagcacgccatgtctgctggacagaggccttggggcagaagaagctct
ggcggccctatctctctgaagtccgagagcccctctacagcaaccagtttggccagttcttcgaggcttgcc
ccgaggaacaccggcagctgcaagaaatggacgtgctcgtgaactacgccgagatcaagagggcgccatgat
ggtgccccactacaacagcaaggccacgtggtggtgtacgtggtggaaggcaccggcagatacgagatggca
tgccccacgtgtccagccagtcttacgagggccaaggacgcagagagcaagaagaggaagagtccaccggac
ggttccagaaagtgaccgccagactggccagaggcgacatcttcgtgatcccagccggacaccctatcgccat
caccgccagccagaacgagaatctgcggctgctgggcttcgacatcaacggcgagaacaaccagcgggacttt
ctggccggacagaacaacatcatcaaccagctggaacggaagccaaagaactgagcttcaacatgcccgcg
aggaaatcgaagagattttcgagagccagatggaaagctacttcgtgcccaccgagcgccagagcagaagggg
ccaagggcgggatcacccactggcctctattctggatttcgccttcttcGAATTC

FIG. 14 (cont.)

SEQ ID NO:137 Amb a 1 amino acids (26-296)
AEDLQEILPVNETRRLTTSGAYNIIDGCWRGKADWAENRKALADCAQGFGKGTVGGKDGDIYTVTSELDDDVA
NPKEGTLRFGAAQNRPLWIIFERDMVIRLDKEMVVNSDKTIDGRGAKVEIINAGFTLNGVKNVIIHNINMHDV
KVNPGGLIKSNDGPAAPRAGSDGDAISISGSSQIWIDHCSLSKSVDGLVDAKLGTTRLTVSNSLFTQHQFVLL
FGAGDENIEDRGMLATVAFNTFTDNVDQRMPRCRHGFFQVVNNNYDKWGSYAIGGSASPTILSQGNRFCAPDE
RSKKNVLGRHGEAAAESMKWNWRTNKDVLENGAIFVASGVDPVLTPEQSAGMIPAEPGESALSLTSSAGVLSC
QPGAPC SEQ ID NO:141 Bet v 1-A amino acids (2-160)
GVFNYETETTSVIPAARLFKAFILDGDNLFPKVAPQAISSVENIEGNGGPGTIKKISFPEGFPFKYVKDRVDE
VDHTNFKYNYSVIEGGPIGDTLEKISNEIKIVATPDGGSILKISNKYHTKGDHEVKAEQVKASKEMGETLLRA
VESYLLAHSDAYN SEQ ID NO:145 Can f 1 amino acids (19-174)
QDTPALGKDTVAVSGKWYLKAMTADQEVPEKPDSVTPMILKAQKGGNLEAKITMLTNGQCQNITVVLHKTSEP
GKYTAYEGQRVVFIQPSPVRDHYILYCEGELHGRQIRMAKLLGRDPEQSQEALEDFREFSRAKGLNQEILELA
QSETCSPGGQ SEQ ID NO:149 Cyn d 1 amino acids (1-246)
AIGDKPGPNITATYGSKWLEARATFYGSNPRGAAPDDHGGACGYKDVDKPPFDGMTACGNEPIFKDGLGCRAC
YEIKCKEPVECSGEPVLVKITDKNYEHIAAYHFDLSGKAFGAMAKKGQEDKLRKAGELTLQFRRVKCKYPSGT
KITFHIEKGSNDHYLALLVKYAAGDGNIVAVDIKPRDSDEFIPMKSSWGAIWRIDPKKPLKGPFSIRLTSEGG
AHLVQDDVIPANWKPDTVYTSKLQFGA SEQ ID NO:153 Der f 1 amino acids (19-321)
RPASIKTFEEFKKAFNKNYATVEEEEVARKNFLESLKYVEANKGAINHLSDLSLDEFKNRYLMSAEAFEQLKT
QFDLNAETSACRINSVNVPSELDLRSLRTVTPIRMQGGCGSCWAFSGVAATESAYLAYRNTSLDLSEQELVDC
ASQHGCHGDTIPRGIEYIQQNGVVEERSYPYVAREQRCRRPNSQHYGISNYCQIYPPDVKQIREALTQTHTAI
AVIIGIKDLRAFQHYDGRTIIQHDNGYQPNYHAVNIVGYGSTQGDDYWIVRNSWDTTWGDSGYGYFQAGNNLM
MIEQYPYVVIM SEQ ID NO:157 Der f 1 amino acids (99-321)
TSACRINSVNVPSELDLRSLRTVTPIRMQGGCGSCWAFSGVAATESAYLAYRNTSLDLSEQELVDCASQHGCH
GDTIPRGIEYIQQNGVVEERSYPYVAREQRCRRPNSQHYGISNYCQIYPPDVKQIREALTQTHTAIAVIIGIK
DLRAFQHYDGRTIIQHDNGYQPNYHAVNIVGYGSTQGDDYWIVRNSWDTTWGDSGYGYFQAGNNLMMIEQYPY
VVIM SEQ ID NO:161 Der p 2 amino acids (18-146)
DQVDVKDCANHEIKKVLVPGCHGSEPCIIHRGKPFQLEAVFEANQNTKTAKIEIKASIDGLEVDVPGIDPNAC
HYMKCPLVKGQQYDIKYTWNVPKIAPKSENVVVTVKVMGDDGVLACAIATHAKIRD SEQ ID NO:165 Der f 2 amino acids (18-146)
DQVDVKDCANNEIKKVMVDGCHGSDPCIIHRGKPFTLEALFDANQNTKTAKIEVKASLDGLEIDVPGIDTNAC
HFVKCPLVKGQQYDIKYTWNVPKIAPKSENVVVTVKLIGDNGVLACAIATHGKIRD SEQ ID NO:169 Der p 1 (DEL) amino acids (1-26:38-223)
TNACSINGNAPAEIDLRQMRTVTPIRSGVAATESAYLAYRNQSLDLAEQELVDCASQHGCHGDTIPRGIEYI
QHNGVVQESYYRYVAREQSCRRPNAQRFGISNYCQIYPQNVNKIREALAQTHSAIAVIIGIKDLDAFRHYDGR
TIIQRDNGYQPNYHAVNIVGYSNAQGVDYWIVRNSWDTNWGDNGYGYFAANIDLMMIEEYPYVVIL SEQ ID NO:174 Fel d 1 chain 1-chain 2 amino acids (23-92/18-109 )

FIG. 14 (cont.)

EICPAVKRDVDLFLTGTPDEYVEQVAQYKALPVVLENARILKNCVDAKMTEEDKENALSLLDKIYTSPLCVKM
AETCPIFYDVFFAVANGNELLLDLSLTKVNATEPERTAMKKIQDCYVENGLISRVLDGLVMTTISSSKDCMGE
AVQNTVEDLKLNTLGR

SEQ ID NO:173  Fel d 1 chain 1-chain 2  amino acids (23-92/18-109 )
EICPAVKRDVDLFLTGTPDEYVEQVAQYKALPVVLENARILKNCVDAKMTEEDKENALSLLDKIYTSPLCGGG
GSGGGGSGGGGSVKMAETCPIFYDVFFAVANGNELLLDLSLTKVNATEPERTAMKKIQDCYVENGLISRVLDG
LVMTTISSSKDCMGEAVQNTVEDLKLNTLGR SEQ ID NO:178  Fel d 2  amino acids (25-608)
EAHQSEIAHRFNDLGEEHFRGLVLVAFSQYLQQCPFEDHVKLVNEVTEFAKGCVADQSAANCEKSLHELLGDK
LCTVASLRDKYGEMADCCEKKEPERNECFLQHKDDNPGFGQLVTPEADAMCTAFHENEQRFLGKYLYEIARRH
PYFYAPELLYYAEEYKGVFTECCEAADKAACLTPKVDALREKVLASSAKERLKCASLQKFGERAFKAWSVARL
SQKFPKAEFAEISKLVTDLAKIHKECCHGDLLECADDRADLAKYICENQDSISTKLKECCGKPVLEKSHCISE
VERDELPADLPPLAVDFVEDKEVCKNYQEAKDVFLGTFLYEYSRRHPEYSVSLLLRLAKEYEATLEKCCATDD
PPACYAHVFDEFKPLVEEPHNLVKTNCELFEKLGEYGFQNALLVRYTKKVPQVSTPTLVEVSRSLGKVGSKCC
THPEAERLSCAEDYLSVVLNRLCVLHEKTPVSERVTKCCTESLVNRRPCFSALQVDETYVPKEFSAETFTFHA
DLCTLPEAEKQIKKQSALVELLKHKPKATEEQLKTVMGDFGSFVDKCCAAEDKEACFAEEGPKLVAAAQAALA SEQ ID NO:182  Fel d 4  amino acids (16-186)
HEEENVVRSNIDISKISGEWYSILLASDVKEKIEENGSMRVFVEHIKALDNSSLSFVFHTKENGKCTEIFLVA
DKTKDGVYTVVYDGYNVFSIVETVYDEYILLHLLNFDKTRPFQLVEFYAREPDVSQKLKEKFVKYCQEHGIVN
ILDLTEVDRCLQARGSEVAQDSSVE SEQ ID NO:186  Lit v 1  amino acids (1-284)
MDAIKKKMQAMKLEKDNAMDRADTLEQQNKEANNRAEKSEEEVHNLQKRMQQLENDLDQVQESLLKANIQLVE
KDKALSNAEGEVAALNRRIQLLEEDLERSEERLNTATTKLAEASQAADESERMRKVLENRSLSDEERMDALEN
QLKEARFLAEEADRKYDEVARKLAMVEADLERAEERAETGESKIVELEEELRVVGNNLKSLEVSEEKANQREE
AYKEQIKTLTNKLKAAEARAEFAERSVQKLQKEVDRLEDELVNEKEKYKSITDELDQTFSELSGY SEQ ID NO:190  Lol p 5a  amino acids (26-272)
ADAGYTPAAAATPATPAATPAAAGGKATTDEQKLLEDVNAGFKAAVAAAANAPPADKFKIFEAAFSESSKGLL
ATSAAKAPGLIPKLDTAYDVAYKAAEATPEAKYDAFVTALTEALRVIAGALEVHAVKPATEEVLAAKIPTGEL
QIVDKIDAAFKIAATAANAAPTNDKFTVFESAFNKALNECTGGAYETYKFIPSLEAAVKQAYAATVAAAPEVK
YAVFEAALTKAITAMTQAQKAGKPAAAA SEQ ID NO:194  Phl p 1  amino acids (24-263)
IPKVPPGPNITATYGDKWLDAKSTWYGKPTGAGPKDNGGACGYKDVDKPPFSGMTGCGNTPIFKSGRGCGSCF
EIKCTKPEACSGEPVVVHITDDNEEPIAPYHFDLSGHAFGAMAKKGDEQKLRSAGELELQFRRVKCKYPEGTK
VTFHVEKGSNPNYLALLVKYVNGDGDVVAVDIKEKGKDKWIELKESWGAIWRIDTPDKLTGPFTVRYTTEGGT
KTEAEDVIPEGWKADTSYESK SEQ ID NO:198 Phl p 5 amino acids (25-288)
AADLGYGPATPAAPAAGYTPATPAAPAEAAPAGKATTEEQKLIEKINAGFKAALAAAAGVQPADKYRTFVATF
GAASNKAFAEGLSGEPKGAAESSSKAALTSKLDAAYKLAYKTAEGATPEAKYDAYVATLSEALRIIAGTLEVH
AVKPAAEEVKVIPAGELQVIEKVDAAFKVAATAANAAPANDKFTVFEAAFNDAIKASTGGAYESYKFIPALEA
AVKQAYAATVATAPEVKYTVFETALKKAITAMSEAQKAAKPAAAA SEQ ID NO:201  Der f 15  amino acids (20-555)

SIKRDHNDYSKNPMRIVCYVGTWSVYHKVDPYTIEDIDPFKCTHLMYGFAKIDEYKYTIQVFDPYQDDNHNSW
EKRGYERFNNLRLKNPELTTMISLGGWYEGSEKYSDMAANPTYRQQFIQSVLDFLQEYKFDGLDLDWEYPGSR
LGNPKIDKQNYLALVRELKDAFEPHGYLLTAAVSPGKDKIDRAYDIKELNKLFDWMNVMTYDYHGGWENFYGH
NAPLYKRPDETDELHTYFNVNYTMHYYLNNGATRDKLVMGVPFYGRAWSIEDRSKLKLGDPAKGMSPPGFISG
EEGVLSYIELCQLFQKEEWHIQYDEYYNAPYGYNDKIWVGYDDLASISCKLAFLKELGVSGVMVWSLENDDFK
GHCGPKNPLLNKVHNMINGDEKNSFECILGPSTTTPTPTTTPTTPTTTPTTPSPTTPTTTPSPTTPTTTPSPT
TPTTTPSPTTPTPTTPTPAPTTSTPSPTTTEHTSETPKYTTYVDGHLIKCYKEGDIPHPTNIHKYLVCEFVNG
GWWVHIMPCPPGTIWCQEKLTCIGE

SEQ ID NO:202  Der f 18  amino acids (18-462)
SNIRPNVATLEPKTVCYYESWVHWRQGEGKMDPEDIDTSLCTHIVYSYFGIDAATHEIKLLDEYLMKDLHDME
HFTQHKGNAKAMIAVGGSTMSDQFSKTAAVEHYRETFVVSTVDLMTRYGFDGVMIDWSGMQAKDSDNFIKLLD
KFDENYNIPAISNYVDFMNVLSLDYTGSWAHTVGHASPFPEQLKTLEAYHKRGAPRHKMVMAVPFYARTWILE
KMNKQDIGDKASGPGPRGQFTQTDGFLSYNELCVQIQAETNAFTITRDHDNTAIYAVYVHSNHAEWISFEDRH
TLGEKAKNITQQGYAGMSVYTLSNEDVHGVCGDKNPLLHAIQSNYYHGVVTEPTVVTLPPVTHTTEHVTDIPG
VFHCHEEGFFRDKTYCATYYECKKGDFGLEKTVHHCANHLQAFDEVSRTCIDHTKIPGC

SEQ ID NO:203  Zen-1  amino acids (23-500)
NPRFKRDNRDDVLKQTEELIKSAQDVLEKLPDSDLKDEIAEKLATMKHYKHELENAKNPIKIAHFELELLTMF
KKFQSLLNEANEIIKSLTTTTTEPTTPTPEPTTTTPEPTTKTPEPTTKTPEPTTPTPEPTTKTPEPTTKTPEP
TTPTPEPTTKTPEPTTPTPEPTTKTPEPTTKTPEPSTPTPEPTTKTPEPTTKTPEPSTPTPEPTTKTPEPSTP
TPEPTTKTPEPTTKTPEPSTPTPEPTTKTPEPSTPTPEPTTKTPEPSTTKKPNRDDVLKQAEELIKRAEDVFE
KLPDSDLKNEIAEKLATMKNYKHELENAKNPIKIAHLESELLTMFKMFQSLLNEADEIIRSLTTTTEPTTLNS
TTPEPTTLNSTTPEPTTLNSTTPEPTTLNSTTPEPTTLNSTTPEPTTLNSTTPEPTTLNSTTPEPTTLNSTTP
EPTTSNSTTSEPTNSINRKTSEISFLSDWFHKIRTRFNIF

SEQ ID NO:204  Cte f 1  amino acids (19-176)
EDIWKVNKKCTSGGKNQDRKLDQIIQKGQQVKIQNICKLIRDKPHTNQEKEKCMKFCKKVCKGYRGACDGNIC
YCSRPSNLGPDWKVSKECKDPNNKDSRPTEIVPYRQQLAIPNICKLKNSETNEDSKCKKHCKEKCRGGNDAGC
DGNFCYCRPKNK

SEQ ID NO:205:  Der F15 GPGPG Der F18 (GPGPG is one example of a linker that can be used)
SIKRDHNDYSKNPMRIVCYVGTWSVYHKVDPYTIEDIDPFKCTHLMYGFAKIDEYKYTIQVFDPYQDDNHNSWEKRGYERF
NNLRLKNPELTTMISLGGWYEGSEKYSDMAANPTYRQQFIQSVLDFLQEYKFDGLDLDWEYPGSRLGNPKIDKQNYLALVR
ELKDAFEPHGYLLTAAVSPGKDKIDRAYDIKELNKLFDWMNVMTYDYHGGWENFYGHNAPLYKRPDETDELHTYFNVNYT
MHYYLNNGATRDKLVMGVPFYGRAWSIEDRSKLKLGDPAKGMSPPGFISGEEGVLSYIELCQLFQKEEWHIQYDEYYNAPY
GYNDKIWVGYDDLASISCKLAFLKELGVSGVMVWSLENDDFKGHCGPKNPLLNKVHNMINGDEKNSFECILGPSTTTPTPTT
TPTTPTTTPTTPSPTTPTTTPSPTTPTTTPSPTTPTPTTPTPAPTTSTPSPTTTEHTSETPKYTTYVDGHLIKCYKEGD
IPHPTNIHKYLVCEFVNGGWWVHIMPCPPGTIWCQEKLTCIGEGPGPGSNIRPNVATLEPKTVCYYESWVHWRQGEGKM
DPEDIDTSLCTHIVYSYFGIDAATHEIKLLDEYLMKDLHDMEHFTQHKGNAKAMIAVGGSTMSDQFSKTAAVEHYRETFVVS
TVDLMTRYGFDGVMIDWSGMQAKDSDNFIKLLDKFDENYNIPAISNYVDFMNVLSLDYTGSWAHTVGHASPFPEQLKTLE
AYHKRGAPRHKMVMAVPFYARTWILEKMNKQDIGDKASGPGPRGQFTQTDGFLSYNELCVQIQAETNAFTITRDHDNTAI
YAVYVHSNHAEWISFEDRHTLGEKAKNITQQGYAGMSVYTLSNEDVHGVCGDKNPLLHAIQSNYYHGVVTEPTVVTLPPVT
HTTEHVTDIPGVFHCHEEGFFRDKTYCATYYECKKGDFGLEKTVHHCANHLQAFDEVSRTCIDHTKIPGC

Der F1 GPGPG Der F2 (SEQ ID NO:206) (with exemplified GPGPG linker)
SIKRDHNDYSKNPMRIVCYVGTWSVYHKVDPYTIEDIDPFKCTHLMYGFAKIDEYKYTIQVFDPYQDDNHNSWEKRGYERF
NNLRLKNPELTTMISLGGWYEGSEKYSDMAANPTYRQQFIQSVLDFLQEYKFDGLDLDWEYPGSRLGNPKIDKQNYLALVR ELKDAFEPHGYLLTAAVSPGKDKIDRAYDIKELNKLFDWMNVMTYDYHGGWENFYGHNAPLYKRPDETDELHTYFNVNYT
MHYYLNNGATRDKLVMGVPFYGRAWSIEDRSKLKLGDPAKGMSPPGFISGEEGVLSYIELCQLFQKEEWHIQYDEYYNAPY
GYNDKIWVGYDDLASISCKLAFLKELGVSGVMVWSLENDDFKGHCGPKNPLLNKVHNMINGDEKNSFECILGPSTTTPTPTT
TPTTPTTPTTPSPTTPTTTPSPTTPTTTPSPTTPTTTPSPTTPTPTTPTPAPTTSTPSPTTTEHTSETPKYTTYVDGHLIKCYKEGD
IPHPTNIHKYLVCEFVNGGWWVHIMPCPPGTIWCQEKLTCIGEGPGPGSNIRPNVATLEPKTVCYYESWVHWRQGEGKM
DPEDIDTSLCTHIVYSYFGIDAATHEIKLLDEYLMKDLHDMEHFTQHKGNAKAMIAVGGSTMSDQFSKTAAVEHYRETFVVS
TVDLMTRYGFDGVMIDWSGMQAKDSDNFIKLLDKFDENYNIPAISNYVDFMNVLSLDYTGSWAHTVGHASPFPEQLKTLE
AYHKRGAPRHKMVMAVPFYARTWILEKMNKQDIGDKASGPGPRGQFTQTDGFLSYNELCVQIQAETNAFTITRDHDNTAI
YAVYVHSNHAEWISFEDRHTLGEKAKNITQQGYAGMSVYTLSNEDVHGVCGDKNPLLHAIQSNYYHGVVTEPTVVTLPPVT
HTTEHVTDIPGVFHCHEEGFFRDKTYCATYYECKKGDFGLEKTVHHCANHLQAFDEVSRTCIDHTKIPGC

SEQ ID NO:248 Ara H 6 (22-145)
MRRERGRQGDSSSCERQVDRVNLKPCEQHIMQRIMGEQEQYDSYDIRSTRSSDQQQRCCDELNEMENTQRCMC
EALQQIMENQCDRLQDRQMVQQFKRELMNLPQQCNFRAPQRCDLDVSGGRC

SEQ ID NO:249 Ara H 8 (1-153)
MGVFTFEDEITSTVPPAKLYNAMKDADSITPKIIDDVKSVEIVEGNGGPGTIKKLTIVEDGETKFILHKVESI
DEANYAYNYSVVGGVALPPTAEKITFETKLVEGPNGGSIGKLTLKYHTKGDAKPDEEELKKGKAKGEGLFRAI
EGYVLANPTQY

SEQ ID NO:250 Ara H 9 (25-116)
ISCGQVNSALAPCIPFLTKGGAPPPACCSGVRGLLGALRTTADRQAACNCLKAAAGSLRGLNQGNAAALPGRC
GVSIPYKISTSTNCATIKF

SEQ ID NO:207 Api m 1 (34-167)
IIYPGTLWCGHGNKSSGPNELGRFKHTDACCRTHDMCPDVMSAGESKHGLTNTASHTRLSCDCDDKFYDCLKN
SADTISSYFVGKMYFNLIDTKCYKLEHPVTGCGERTEGRCLHYTVDKSKPKVYQWFDLRKY

SEQ ID NO:208 Api m 2 (34-382)
PDNNKTVREFNVYWNVPTFMCHKYGLRFEEVSEKYGILQNWMDKFRGEEIAILYDPGMFPALLKDPNGNVVAR
NGGVPQLGNLTKHLQVFRDHLINQIPDKSFPGVGVIDFESWRPIFRQNWASLQPYKKLSVEVVRREHPFWDDQ
RVEQEAKRRFEKYGQLFMEETLKAAKRMRPAANWGYYAYPYCYNLTPNQPSAQCEATTMQENDKMSWLFESED
VLLPSVYLRWNLTSGERVGLVGGRVKEALRIARQMTTSRKKVLPYYWYKYQDRRDTDLSRADLEATLRKITDL
GADGFIIWGSSDDINTKAKCLQFREYLNNELGPAVKRIALNNNANDRLTVDVSVDQV

SEQ ID NO:209 Api m 3 (16-388)
ELKQINVIFRHGDRIPDEKNEMYPKDPYLYYDFYPLERGELTNSGKMREYQLGQFLRERYGDFLGDIYTEESV
SALSSFYDRTKMSLQLVLAALYPPNKLQQWNEDLNWQPIATKYLRRYEDNIFLPEDCLLFTIELDRVLESPRG
KYEFSKYDKLKKKLEEWTGKNITTPWDYYYIYHTLVAEQSYGLTLPSWTNNIFPRGELFDATVFTYNITNSTP
LLKKLYGGPLLRIFTKHMLDVVSGTQKKKRKIYLFSGHESNIASVLHALQLYYPHVPEYSSSIIMELHNIEGT
HYVKIVYYLGIPSEARELQLPGCEVLCPLYKYLQLIENVIPSNEELICDKRFVDESANNLSIEELDFV
KLNLIRIAGTENK

SEQ ID NO:210 Api m 5 (24-775)
KSVPRVIDQDLERYEPLEEEDHRGARVPFNLEETYDQSFRANSFNGTWKTDREILYSDNYVGDIRLFDVTTGS
GTVLLDSSVTADFDKASVMFSFDNSHVAIGHDYVNGFRYSIHQKCTVYNIKSRTFTDIANGDRIPLFKWSPTR
NALIYVHKNDIYYQVFFEGGSDTRRITNTGVPDIVFNGIPDWVYEEEVLGSPVAFWISPDGRHLAFATFNDTN
VRDIVISKYGSPGNSRDQYPNEIRIKYPKAGTTNPFVSLSVIDLHDPSSKLIDLPPPVDVVGADNVLYTANWR
RDGEIVATWTNRVQNKAQLVLYDTKGNANNIYYEEETEGWLRIQPPLYHDRYVIVAKLQDSGTKAGRFLHATR
LEYRNGALVDETDLTPGTCEVISLLLVDHARARLYYLGTELGKPSHKNLYSVQLSGNEPPVCLSCDVLTPEGN
RCTYAYAYFSTNGSHYALYCAGPDPVFIAIVNANHRQISIWEENRSLRRKLAARTQPIVKNFNVNANGYTNKV
KLYLPPDFDETKKYPLLITVYAGPNTIRITEEATYGFESYIVTNRSVIYGRIDGRGSAYKGSKMLFEIYRRLG

TVEIEDQIIITRTLQEKYSWIDSNRTGIWGWSYGGFSAAMVLATDAESVFKCGISVAPVTSWIYYDSLYTERF
MGLPTPEDNQSGYNDTDVSRRVEGMRGKKYMLIHGTADDNVHYQQTMMLNKALVNSDIMFQQQTYTDEAHALG
NVFPHLYHTTDRFWANCLGYSH

SEQ ID NO:211 Api m 10 (20-223)
FPGAHDEDSKEERKNVDTVLVLPSIERDQMMAATFDFPSLSFEDSDEGSNWNWNTLLRPNFLDGWYQTLQSAI
SAHMKKVREQMAGILSRIPEQGVVNWNKIPEGANTTSTTKIIDGHVVTINETTYTDGSDDYSTLIRVRVIDVR
PQNETILTTVSSEADSDVTTLPTLIGKNETSTQSSRSVESVEDFDNEIPKNQGDVLTA

SEQ ID NO:212 Ves v 1 (37-336)
GPKCPFNSDTVSIIIETRENRNRDLYTLQTLQNHPEFKKKTITRPVVFITHGFTSSASETNFINLAKALVDKD
NYMVISIDWQTAACTNEAAGLKYLYYPTAARNTRLVGQYIATITQKLVKHYKISMANIRLIGHSLGAHASGFA
GKKVQELKLGKYSEIIGLDPARPSFDSNHCSERLCETDAEYVQIIHTSNYLGTEKTLGTVDFYMNNGKNQPGC
GRFFSEVCSHSRAVIYMAECIKHECCLIGIPKSKSSQPISSCTKQECVCVGLNAKKYPSRGSFYVPVESTAPF
CNNKGKII

SEQ ID NO:213 Ves v 2 (1-331)
SERPKRVFNIYWNVPTFMCHQYDLYFDEVTNFNIKRNSKDDFQGDKIAIFYDPGEFPALLSLKDGKYKKRNGG
VPQEGNITIHLQKFIENLDKIYPNRNFSGIGVIDFERWRPIFRQNWGNMKIHKNFSIDLVRNEHPTWNKKMIE
LEASKRFEKYARFFMEETLKLAKKTRKQADWGYYGYPYCFNMSPNNLVPECDVTAMHENDKMSWLFNNQNVLL
PSVYVRQELTPDQRIGLVQGRVKEAVRISNNLKHSPKVLSYWWYVYQDETNTFLTETDVKKTFQEIVINGGDG
IIIWGSSSDVNSLSKCKRLQDYLLTVLGPIAINVTEAVN

SEQ ID NO:214 Ves v 3 (26-776)
RVIDKDNSDRIVKTQNDQNLSKVPFNLEETYTADFLAYVFNGTWTSDTTIVYTDRRTGDILQFDVIKQRSTLI
VDSSVMDAYIVSNYVLSPKGRYLLIGYDLKKGYRYSTFMRYVIYDIEHRAYHKIGNDMHIALAKWAPLTDDLI
YILDNDIYYMRFSNNGFNDVQRVTYDGISGIVYNGVPDWVYEEEVLQDSSAIWFSPDGNHLAYASFDDRNVQE
ILYLHYGEPGNLDDQYPTEVKIKYPKVGTLNPVVSLTLVDLHDPTLNKIDLKAPHYAVGTDNLLYNVQWKDFD
HVVVTWSNRVQNKTEIVWYNMYGEIVKTLHVVEHKGWLDIKHLFFYKGSVYIRKLQPSGTKAGRFHHVTRYDE
TFKQSPTQMDLTPDAIEVQNICTIDQSNGRIYYLASGLGKPSQKNLYSVPADGSEKPTCISCNVLTPEGNVCT
YADAIFSPLGQYYVLVCHGPDPAFVSIFNNAHQKVYSWENNLSLRKKLAKRHLPLVKDLDVRANGYESKVRLF
LPHNFDESKSYPMLVNVYAGPNTLKIIDAASYGHQVYMTTNRSVIYAYIDGRGSSNKGSKMLFSIYRKLGTVE
VEDQITVTRQLQEMFPWIDSKRTGVWGWSYGGFSTAMILAKDTSFVFKCGIAIAPVSSWIYYDSIYTERFMGF
PTPEDNLSGYNETDVSRRVEDIRGKKFMLIHGSDDNVHYQQSLALAKALEKADVMFEQITYTDEAHALFGVL
PHLYHTMDRFWSDCFSLSHAH

SEQ ID NO:215 Ves v 5 (24-227)
NNYCKIKCLKGGVHTACKYGSLKPNCGNKVVVSYGLTKQEKQDILKEHNDFRQKIARGLETRGNPGPQPPAKN
MKNLVWNDELAYVAQVWANQCQYGHDTCRDVAKYQVGQNVALTGSTAAKYDDPVKLVKMWEDEVKDYNPKKKF
SGNDFLKTGHYTQMVWANTKEVGCGSIKYIQEKWHKHYLVCNYGPSGNFMNEELYQTK

SEQ ID NO:216 Pol d 1 (36-337)
GITPDCTFNEKDIELHVYSRDKRNGIILKKEILKNYDLFQKSQISHQIAILIHGFLSTGNNENFDAMAKALIE
IDNFLVISVDWKKGACNAFASTNDVLGYSQAVGNTRHVGKYVADFTKLLVEQYKVPMSNIRLIGHSLGAHTSG
FAGKEVQRLKLGKYKEIIGLDPAGPSFLTNKCPNRLCETDAEYVQAIHTSAILGVYYNVGSVDFYVNYGKSQP
GCSEPSCSHTKAVKYLTECIKRECCLIGTPWKSYFSTPKPISQCKRDTCVCVGLNAQSYPAKGSFYVPVDKDA
PYCHNEGIKL

SEQ ID NO:217 Pol d 5 (22-227)
NDYCKIKCSSGVHTVCQYGESTKPSKNCAGKLIKSVGPTEEEKKLIVEEHNRFRQKVAKGLETRGNPGPQPAA
SNMNNLVWNDELAKIAQVWASQCQILVHDKCRNTEKYQVGQNIAYAGSSNHFPSVTKLIQLWENEVKDFNYNT
GITNKNFGKVGHYTQMVWGNTKEVGCGSLKYVEKNMQIHYLICNYGPAGNYLGQPIYTKK

SEQ ID NO:218:P43238.1 RecName: Full=Allergen Ara h 1, clone P41B; AltName:
Full=Allergen Ara h I; AltName: Allergen=Ara h 1; Flags: Precursor; signal sequence
underlined
MRGRVSPLMLLLGILVLASVSATHAKSSPYQKKTENPCAQRCLQSCQQEPDDLKQKACESRCTKLEYDPRCVYDPRGHTG
TTNQRSPPGERTRGRQPGDYDDDRRQPRREEGGRWGPAGPREREREEDWRQPREDWRRPSHQQPRKIRPEGREGEQEWGT
PGSHVREETSRNNPFYFPSRRFSTRYGNQNGRIRVLQRFDQRSRQFQNLQNHRIVQIEAKPNTLVLPKHADADNILVIQQ
GQATVTVANGNNRKSFNLDEGHALRIPSGFISYILNRHDNQNLRVAKISMPVNTPGQFEDFFPASSRDQSSYLQGFSRNT
LEAAFNAEFNEIRRVLLEENAGGEQEERGQRRWSTRSSENNEGVIVKVSKEHVEELTKHAKSVSKKGSEEEGDITNPINL
REGEPDLSNNFGKLFEVKPDKKNPQLQDLDMMLTCVEIKEGALMLPHFNSKAMVIVVVNKGTGNLELVAVRKEQQQRGRR
EEEEDEDEEEEGSNREVRRYTARLKEGDVFIMPAAHPVAINASSELHLLGFGINAENNHRIFLAGDKDNVIDQIEKQAKD
LAFPGSGEQVEKLIKNQKESHFVSARPQSQSQSPSSPEKESPEKEDQEEENQGGKGPLLSILKAFN > SEQ ID NO:219: AAM78596.1 allergen Ara h 2 isoform, partial [Arachis hypogaea]
LTILVAPALFLLAAHASARQQWELQGDRRCQSQLERANLRPCEQHLMQKIQRDEDSYGRDPYSPSQDPYSPSQ
DPDRRDPYSPSPYDRRGAGSSQHQERCCNELNEFENNQRCMCEALQQIMENQSDRLQGRQQEQQFKRELRNLP
QQCGLRAPQRCDLEVESGGRDRY > SEQ ID NO:220; ADQ53859.1 Ara h 3 allergen [Arachis hypogaea](signal sequence
underlined)
MAKLLALSLCFCVLVLGASSVTFRQGGEENECQFQRLNAQRPDNRIESEGGYIETWNPNNQEFQCAGVALSRTVLRRNAL
RRPFYSNAPLEIYVQQGSGYFGLIFPGCPSTYEEPAQEGRRYQSQKPSRRFQVGQDDPSQQQQDSHQKVHRFDEGDLIAV
PTGVAFWMYNDEDTDVVTVTLSDTSSIHNQLDQFPRRFYLAGNQEQEFLRYQQQQGSRPHYRQISPRVRGDEQENEGSNI
FSGFAQEFLQHAFQVDRQTVENLRGENEREEQGAIVTVKGGLRILSPDEEDESSRSPPNRREEFDEDRSRPQQRGKYDEN
RRGYKNGIEETICSASVKKNLGRSSNPDIYNPQAGSLRSVNELDLPILGWLGLSAQHGTIYRNAMFVPHYTLNAHTIVVA
LNGRAHVQVVDSNGNRVYDEELQEGHVLVVPQNFAVAAKAQSENYEYLAFKTDSRPSIANQAGENSIIDNLPEEVVANSY
RLPREQARQLKNNNPFKFFVPPFDHQSMREVA > SEQ ID NO:221: One example of an Ara H1-H2-H3 construct:
KSSPYQKKTENPCAQRCLQSCQQEPDDLKQKACESRCTKLEYDPRCVYDPRGHTGTTNQRSPPGERTRGRQPGDYDDDRR
QPRREEGGRWGPAGPREREREEDWRQPREDWRRPSHQQPRKIRPEGREGEQEWGTPGSHVREETSRNNPFYFPSRRFSTR
YGNQNGRIRVLQRFDQRSRQFQNLQNHRIVQIEAKPNTLVLPKHADADNILVIQQGQATVTVANGNNRKSFNLDEGHALR
IPSGFISYILNRHDNQNLRVAKISMPVNTPGQFEDFFPASSRDQSSYLQGFSRNTLEAAFNAEFNEIRRVLLEENAGGEQ
EERGQRRWSTRSSENNEGVIVKVSKEHVEELTKHAKSVSKKGSEEEGDITNPINLREGEPDLSNNFGKLFEVKPDKKNPQ
LQDLDMMLTCVEIKEGALMLPHFNSKAMVIVVVNKGTGNLELVAVRKEQQQRGRREEEEDEDEEEEGSNREVRRYTARLK
EGDVFIMPAAHPVAINASSELHLLGFGINAENNHRIFLAGDKDNVIDQIEKQAKDLAFPGSGEQVEKLIKNQKESHFVSA
RPQSQSQSPSSPEKESPEKEDQEEENQGGKGPLLSILKAFNggggLTILVAPALFLLAAHASARQQWELQGDRRCQSQLE
RANLRPCEQHLMQKIQRDEDSYGRDPYSPSQDPYSPSQDPDRRDPYSPSPYDRRGAGSSQHQERCCNELNEFENNQRCMC
EALQQIMENQSDRLQGRQQEQQFKRELRNLPQQCGLRAPQRCDLEVESGGRDRYggggVTFRQGGEENECQFQRLNAQRP
DNRIESEGGYIETWNPNNQEFQCAGVALSRTVLRRNALRRPFYSNAPLEIYVQQGSGYFGLIFPGCPSTYEEPAQEGRRY
QSQKPSRRFQVGQDDPSQQQQDSHQKVHRFDEGDLIAVPTGVAFWMYNDEDTDVVTVTLSDTSSIHNQLDQFPRRFYLAG
NQEQEFLRYQQQQGSRPHYRQISPRVRGDEQENEGSNIFSGFAQEFLQHAFQVDRQTVENLRGENEREEQGAIVTVKGGL
RILSPDEEDESSRSPPNRREEFDEDRSRPQQRGKYDENRRGYKNGIEETICSASVKKNLGRSSNPDIYNPQAGSLRSVNE
LDLPILGWLGLSAQHGTIYRNAMFVPHYTLNAHTIVVALNGRAHVQVVDSNGNRVYDEELQEGHVLVVPQNFAVAAKAQS
ENYEYLAFKTDSRPSIANQAGENSIIDNLPEEVVANSYRLPREQARQLKNNNPFKFFVPPFDHQSMREVA > SEQ ID NO:222; BAA05543.1 Cry j 1B precursor [Cryptomeria japonica](signal
sequence underlined)
MDSPCLVALLVFSFVIGSCFSDNPIDSCWRGDSNWAQNRMKLADCAVGFGSSTMGGKGGDLYTVTNSDDDPVNPAPGTLR
YGATRDRPLWIIFSGNMNIKLKMPMYIAGYKTFDGRGAQVYIGNGGPCVFIKRVSNVIIHGLYLYGCSTSVLGNVLINES
FGVEPVHPQDGDALTLRTATNIWIDHNSFSNSSDGLVDVTLTSTGVTISNNLFFNHHKVMSLGHDDAYSDDKSMKVTVAF
NQFGPNCGQRMPRARYGLVHVANNNYDPWTIYAIGGSSNPTILSEGNSFTAPNESYKKQVTIRIGCKTSSSCSNWVWQST
QDVFYNGAYFVSSGKYEGGNIYTKKEAFNVENGNATPHLTQNAGVLTCSLSKRC > SEQ ID NO:223; BAC23083.1 allergen Cry j 2 [Cryptomeria japonica](signal
sequence underlined)
MAMKLIAPMAFLAMQLIIMAAVEDQSAQIMLDSVVEKYLRSNRSLRKVEHSRHDAINIFNVEKYGAVGDGKHDCTEAFST
AWQAACKNPSAMLLVPGSKKFVVNNLFFNGPCQPHFTFKVDGIIAAYQNPASWKNNRIWLQFAKLTGFTLMGKGVIDGQG

FIG. 14 (cont.)

```
KQWWAGQCKWVNGREICNDRDRPTAIKFDFSTGLIIQGLKLMNSPEFHLVFGNCEGVKIIGISITAPRDSPNTDGIDIFA
SKNFHLQKNTIGTDDCVAIGTGSSNIVIEDLICGPGHGISIGSLGRENSRAEVSYVHVNGAKFIDTQNGLRIKTWQGGS
GMASHIIYENVEMINSENPILINQFYCTSASACQNQRSAVQIQDVTYKNIRGTSATAAAIQLKCSDSMPCKDIKLSDISL
KLTSGKIASCLNDNANGYFSGHVIPACKNLSPSAKRKESKSHKHPKTVMVENMRAYDKGNRTRILLGSRPPNCTNKCHGC
SPCKAKLVIVHRIMPQEYYPQRWICSCHGKIYHP
```

SEQ ID NO:224: Cry J1 and CryJ2 Construct

```
Glu Asp Asn Pro Ile Asp Ser Cys Trp Arg Gly Asp Ser Asn Trp Ala Gln Asn Arg Met
Lys Leu Ala Asp Cys Ala Val Gly Phe Gly Ser Ser Thr Met Gly Gly Lys Gly Gly Asp
Leu Tyr Thr Val Thr Asn Ser Asp Asp Asp Pro Val Asn Pro Ala Pro Gly Thr Leu Arg
Tyr Gly Ala Thr Arg Asp Arg Pro Leu Trp Ile Ile Phe Ser Gly Asn Met Asn Ile Lys
Leu Lys Met Pro Met Tyr Ile Ala Gly Tyr Lys Thr Phe Asp Gly Arg Gly Ala Gln Val
Tyr Ile Gly Asn Gly Gly Pro Cys Val Phe Ile Lys Arg Val Ser Asn Val Ile Ile His
Gly Leu His Leu Tyr Gly Cys Ser Thr Ser Val Leu Gly Asn Val Leu Ile Asn Glu Ser
Phe Gly Val Glu Pro Val His Pro Gln Asp Gly Asp Ala Leu Thr Leu Arg Thr Ala Thr
Asn Ile Trp Ile Asp His Asn Ser Phe Ser Asn Ser Ser Asp Gly Leu Val Asp Val Thr
Leu Ser Ser Thr Gly Val Thr Ile Ser Asn Asn Leu Phe Phe Asn His His Lys Val Met
Leu Leu Gly His Asp Asp Ala Tyr Ser Asp Asp Lys Ser Met Lys Val Thr Val Ala Phe
Asn Gln Phe Gly Pro Asn Cys Gly Gln Arg Met Pro Arg Ala Arg Tyr Gly Leu Val His
Val Ala Asn Asn Asn Tyr Asp Pro Trp Thr Ile Tyr Ala Ile Gly Gly Ser Ser Asn Pro
Thr Ile Leu Ser Glu Gly Asn Ser Phe Thr Ala Pro Asn Glu Ser Tyr Lys Lys Gln Val
Thr Ile Arg Ile Gly Cys Lys Thr Ser Ser Ser Cys Ser Asn Trp Val Trp Gln Ser Thr
Gln Asp Val Phe Tyr Asn Gly Ala Tyr Phe Val Ser Ser Gly Lys Tyr Glu Gly Gly Asn
Ile Tyr Thr Lys Lys Glu Ala Phe Asn Val Glu Asn Gly Asn Ala Thr Pro Gln Leu Thr
Lys Asn Ala Gly Val Leu Thr Cys Ser Leu Ser Lys Arg Cys gly pro gly pro gly Leu
Glu Asp Gln Ser Ala Gln Ile Met Leu Asp Ser Val Val Glu Lys Tyr Leu Arg Ser Asn
Arg Ser Leu Arg Lys Val Glu His Ser Arg His Asp Ala Ile Asn Ile Phe Asn Val Glu
Lys Tyr Gly Ala Val Gly Asp Gly Lys His Asp Cys Thr Glu Ala Phe Ser Thr Ala Trp
Gln Ala Ala Cys Lys Asn Pro Ser Ala Met Leu Leu Val Pro Gly Ser Lys Lys Phe Val
Val Asn Asn Leu Phe Phe Asn Gly Pro Cys Gln Pro His Phe Thr Phe Lys Val Asp Gly
Ile Ile Ala Ala Tyr Gln Asn Pro Ala Ser Trp Lys Asn Asn Arg Ile Trp Leu Gln Phe
Ala Lys Leu Thr Gly Phe Thr Leu Met Gly Leu Gly Val Ile Asp Gly Gln Gly Lys Gln
Trp Trp Ala Gly Gln Cys Lys Trp Val Asn Gly Arg Glu Ile Cys Asn Asp Arg Asp Arg
Pro Thr Ala Ile Lys Phe Asp Phe Ser Thr Gly Leu Ile Ile Gln Gly Leu Lys Leu Met
Asn Ser Pro Glu Phe His Leu Val Phe Gly Asn Cys Glu Gly Val Lys Ile Ile Gly Ile
Ser Ile Thr Ala Pro Arg Asp Ser Pro Asn Thr Asp Gly Ile Asp Ile Phe Ala Ser Lys
Asn Phe His Leu Gln Lys Asn Thr Ile Gly Thr Gly Asp Asp Cys Val Ala Ile Gly Thr
Gly Ser Ser Asn Ile Val Ile Glu Asp Leu Ile Cys Gly Pro Gly His Gly Ile Ser Ile
Gly Ser Leu Gly Arg Glu Asn Ser Arg Ala Glu Val Ser Tyr Val His Val Asn Gly Ala
Lys Phe Ile Asp Thr Gln Asn Gly Leu Arg Ile Lys Thr Trp Gln Gly Gly Ser Gly Met
Ala Ser His Ile Ile Tyr Glu Asn Val Glu Met Ile Asn Ser Glu Asn Pro Ile Leu Ile
Asn Gln Phe Tyr Cys Thr Ser Ala Ser Ala Cys Gln Asn Gln Arg Ser Ala Val Gln Ile
Gln Asp Val Thr Tyr Lys Asn Ile Arg Gly Thr Ser Ala Thr Ala Ala Ala Ile Gln Leu
Lys Cys Ser Asp Ser Met Pro Cys Lys Asp Ile Lys Leu Ser Asp Ile Ser Leu Lys Leu
Thr Ser Gly Lys Ile Ala Ser Cys Leu Asn Asp Asn Ala Asn Gly Tyr Phe Ser Gly His
Val Ile Pro Ala Cys Lys Asn Leu Ser Pro Ser Ala Lys Arg Lys Glu Ser Lys Ser His
Lys His Pro Lys Thr Val Met Val Glu Asn Met Arg Ala Tyr Asp Lys Gly Asn Arg Thr
Arg Ile Leu Leu Gly Ser Arg Pro Pro Asn Cys Thr Asn Lys Cys His Gly Cys Ser Pro
Cys Lys Ala Lys Leu Val Ile Val His Arg Ile Met Pro Gln Glu Tyr Tyr Pro Gln Arg
Trp Ile Cys Ser Cys His Gly Lys Ile Tyr His Pro
```

SEQ ID NO: 225 - Cryptomeria japonica (signal sequence is underlined)

<u>MAKVSDLALLLVAGMAISLYIQETGAVKFDIKNQCGYTVWAAGLPGGGQQLTQGQTWTVNLAAGTQSARFWGRTGCSFDA</u>
SGKGTCQTGDCGGQLSCTVSGAVPATLAEYTQSDQDYYDVSLVDGFNIPLSINPTNAQCTAPACKADVNAVCPAELKVDG
GCKSACAAFQTDQYCCTGTYANSCPATNYSMIFKNQCPQAYSYPKDDTATFACPSGTDYSIVFCP

FIG. 14 (cont.)

SEQ ID NO: 226 - Cryptomeria japonica (signal sequence is underlined)
<u>MGIMATQNSKSNIFWSSSASVVLVLLLLVDVGVCQNCGCNGLCCSQYGYCGSGEAYCGAGCKEGPCSSSSPPSTGTGVGS</u>
IVSSDVFNSIVGGAASGCAGNGFYTYDSFISAANAFNGFGTSGSSDVNKREIAAFFANAAHETGGFCYIEEQNPTSIYCD
ASNTQYPCASGKTYHGRGPLQLSWNYNYGAAGSYIQFDGLNNPEIVGTDSTISFKTAVWFWMVNSNCHTAITSGQGFGAT
IRAINSMECDGGNAATVASRVNYYQKFCQQLNVDTGSALQC SEQ ID NO: 227 - Cryptomeria japonica (signal sequence is underlined)
<u>MGGSRVLIIGGTGYIGRHVTNASLAQGHPTFLLVREITPSNPEKAQLLESFTSKGATLVQGSIDDHASLVAALKKVDVVI</u>
STLGAPQIADQFNLIKAIKEVGTIKRFFPSEFGNDVDKHHAVEPMKSMFDLKIKLPRRTIEAEGIPHTYVVPHCFAGYFLT
NLAQLGLAAPPRDKIVIYGDGTTKAVYMKEEDIGTFTIKAVDDPRTLNKTLYLKPPANTISTNDLVALWEAKIGKTLEKV
YLSEEQVLKLLQDTPFPGTFMVSIFHTIYVKGDQTNFQIGPDGVEASALYPDVKYTTVEEYISAFV SEQ ID NO: 228 - Cryptomeria japonica (signal sequence is underlined)
<u>MAMRMKSSSMSSYRFSYCQMMLVLMVMTLVQIGAAQSDTNSCVNSLVPCASYLNATTKPPDSCCVPLLNVIQTQQQCLCN</u>
LLNSSIVKQSSINITQALNIPRLCGDTNVSTDACSTNATANAPSASTTPSVPADTGDSSGIGATSLQIFLPLLAVFFLGV
FKSFP SEQ ID NO: 229 - Cryptomeria japonica (signal sequence is underlined)
<u>MARRLCSFLLSFLIIVSVWAENSKFARLNLASFTWKDAEDNKNCSAGELETSSLSVMHIQGKCSPFRLLNSSWWTAVSES</u>
IKGDTARYRAMVKGGWSAGKTMVNPQEDADIPLASGQAESSSNYIIKLGFGTPPQSFYTVLDTGSNIAWIPCNPCSGCSS
KQQPFEPSKSSTYNYLTCASQQCQLLRVCTKSDNSVNCSLTQRYGDQSEVDEILSSETLSVGSQQVENFVFGCSNAARGL
IQRTPSLVGFGRNPLSFVSQTATLYDSTFSYCLPSLFSSAFTGSLLLGKEALSAQGLKFTPLLSNSRYPSFYYVGLNGIS
VGEELVSIPAGTLSLDESTGRGTIIDSGTVITRLVEPAYNAMRDSFRSQLSNLTMASPTDLFDTCTNRPSGDVEFPLITL
HFDDNLDLTLPLDNILYPGNDDGSVLCLAFGLPPGGGDDVLSTFGNYQQQKLRIVHDVAESRLGIASGNCDG SEQ ID NO: 230 - Cryptomeria japonica (signal sequence is underlined)
<u>MELLKQHRYMFLLISCIVILLNSMHADCEQIGVNYGMDGNNLPSAGDVVSLMKKNNIGKMRIFGPNADVLRAFANSRIEV</u>
IVGVENKGLEAVASSQDSANGWVNDNIKPFYFSTNIKYIAVGNEVLEMPDNAQYVSFLVPAIKNIQTALENANLQNNIKV
STAHAMTVIGTSSPPSKGTFKDAVKDSMSSILQFLQDHGSPFMANVYPYFSYDGDRSIKLDYALFNPTPPVVDEGLSYTN
LFDAMVDAVLSAMESLGHPNIPIVITESGWPSAGKSVATIENAQTYNNNLIKHVLSNAGTPKRPGSSIETYIFALFNENL
KGPAEVEKHFGLFNPDEQPVYPVKFSLN SEQ ID NO: 231 - Chamaecyparis obtusa (signal sequence is underlined)
<u>MASCTLLAVLVFLCAIVSCF</u>SDNPIDSCWRGDANWDQNRMKLADCAVGFGSSAMGGKGGAFYTVTSSDDDPVNPAPGTLR
YGATRERSLWIIFSKNLNIKLNMPLYIAGNKTIDGRGAEVHIGNGGPCLFMRTVSHVILHGLNIHGCNTSVSGNVLISEA
SGVVPVHAQDGDAITMRNVTDVWIDHNSLSDSSDGLVDVTLASTGVTISNNHFFNHHKVMLLGHSDIYSDDKSMKVTVAF
NQFGPNAGQRMPRARYGLIHVANNNYDPWSIYAIGGSSNPTILSEGNSFTAPNDSDKKEVTRRVGCESPSTCANWVWRST
QDSFNNGAYFVSSGKNEGTNIYNNNEAFKVENGSAAPQLTKNAGVLTCILSKPCS SEQ ID NO: 232 - Juniperus ashei (signal sequence is underlined)
<u>MASPCLIAVLVFLCAIVSCY</u>SDNPIDSCWRGDSNWDQNRMKLADCAVGFGSSTMGGKGGDFYTVTSTDDNPVNPTPGTLR
YGATREKALWIIFSQNMNIKLKMPLYVAGHKTIDGRGADVHLGNGGPCLFMRKVSHVILHSLHIHGCNTSVLGDVLVSES
IGVEPVHAQDGDAITMRNVTNAWIDHNSLSDCSDGLIDVTLGSTGITISNNHFFNHHKVMLLGHDDTYDDDKSMKVTVAF
NQFGPNAGQRMPRARYGLVHVANNNYDPWNIYAIGGSSNPTILSEGNSFTAPSESYKKEVTKRIGCESPSACANWVWRST
RDAFINGAYFVSSGKTEETNIYNSNEAFKVENGNAAPQLTKNAGVVT SEQ ID NO: 233 - Juniperus virginiana (signal sequence is underlined)
<u>MASPCLIAFLVFLCAIVSCC</u>SDNPIDSCWRGDSNWGQNRMKLADCAVGFGSSTMGGKGGDFYTVTSADDNPVNPTPGTLR
YGATREKTLWIIFSQNMNIKLKMPLYVAGHKTIDGRGADVHLGNGGPCLFMRKVSHVILHGLHIHGCNTSVLGDVLVSES
IGVVPVHAQDGDAITMRNVTNAWIDHNSLSDCSDGLIDVTLGSTGITIFNNHFFNHHKVMLLGHDDTYDDDKSMKVTVAF
NQFGPNAGQRMPRARYGLVHVANNNYDPWNIYAIGGSSNPTILSEGNSFTAPNENYKYEVTKRIGCESTSACANWVWRST
RDAFSNGAYFVSSGKIEETNIYNSNEAFKVENGNAAPQLTKNAGVVA SEQ ID NO: 234 - Hexalectris arizonica (signal sequence is underlined)
<u>MASPCLVAVLVFLCAIVSCY</u>SDNPIDSCWRGDSNWDQNRMKLADCVVGFGSLTMGGKGGEIYTVTSSDDNPVNPTPGTLR
YGATREKALWIIFSQNMNIKLQMPLYVAGYKTIDGRGADVHLGNGGPCLFMRTASHVILHGLHIHGCNTSVLGDVLVSES
IGVEPVHAQDGDAITMRNVTNAWIDHNSLSDCSDGLIDVTLGSTGITISNNHFFNHHKVMLLGHDDTYDDDISMKVTVAF
NQFGPNAGQRMPRARYGLVHVANNNYDQWNIYAIGGSSNPTILSEGNSPTAPSESYKKEVTKRIGCESTSACANWVWRFT
RDAFTNGAYFVSSGKAEETNIYNSNEAFKVENGNAAPQLTQNAGVVT

FIG. 14 (cont.)

SEQ ID NO: 235 - Juniperus oxycedrus (signal sequence is underlined)
<u>MASPCLRAVLVFLCAIVSCYS</u>DNPIDSCWRGDSNWGQNRMKLADCVVGFGSSTMGGKGGEFYTVTSAEDNPVNPTPGTLR
YGATREKALWIIFSQNMNIKLKMPLYVAGHKTIDGRGADVHLGNGGPCLFMRKVSHVILHGLHIGCNTSVLGDVLVSESI
GVEPVHAQDGDAITMRNVTNAWIDHNSLSDCSDGLIDVTLGSTGITISNNHFFNHHKVMLLGHDDTYDNDKSMKVTVAFN
QFGPNAGQRMPRARYGLVHVANNNYDPWNIYAIGGSSNPTILSEGNSFTAPSESYKKEVTKRIGCESTSACANWVWRSTR
DAFTNGAYFVSSGKIEETNIYNSNEAFKVENGNAAPQLTKNAGVVT

SEQ ID NO: 236 - Cupressus sempervirens (signal sequence is underlined)
<u>MDSPCLIAVLVFLCAIVSCYS</u>DNPIDSCWRGDSNWDQNRMKLADCAVGFGSSTMGGKGGDIYTVTSAEDNPVNPTPGTLR
YGATREKALWIIFSQNMNIKLKMPLYVAGHKTIDGRGADVHLGNGGPCLFMRKVSHVILHGLHIHGCNTSVLGNVLVSES
IGVEPVHAQDGDAITMRNVTNAWIDHNSLSDCSDGLIDVTLSSTGITISNNHFFNHHKVMLLGHDDTYDDDKSMKVTVAF
NQFGPNAGQRMPRARYGLVHVANNNYDQWNIYAIGGSSNPTILSEGNSFAAPNENYKKEVTKRIGCVSTSACANWVWRST
RDAFSNGAYFVSSGKTEETNIYTSNEAFKVENGNLAPQLTKNAGVVA

SEQ ID NO: 237 - Chamaecyparis obtusa (signal sequence is underlined)
<u>MGMKFMAAVAFLALQLIVMAAAE</u>DQSAQIMLDSDIEEYLRSNRSLKKLVHSRHDAATVFNVEQYGAVGDGKHDSTEAFAT
TWNAACCKKASAVLLVPANKKFFVNNLVFRGPCQPHLSFKVDGTIVAQPDPARWKNSKIWLQFAQLTDFNLMGTFVIDGQG
QQWWAGQCKVVNGRTVCNDRNRPTAIKIDYSKSVTVKELTLMNSPEFHLVFGECEGVKIQGLKIKAPRDSPNTDGIDIFA
SKRFHIEKCVIGTGDDCIAIGTGSSNITIKDLICGPGHGISIGSLGRDNSRAEVSHVHVNRAKFIDTQNGLRIKTWQGGS
GLASYITYENVEMINSENPILINQFYCTSASACQNQRSAVQIQGVTYKNIHGTSATAAAIQLMCSDSVPCTGIQLSNVSL
KLTSGKPASCVDKNARGFYSGRLIPTCKNLRPGPSPKEFELQQQPTTVMDENKGACAKGDSTCISLSSSPPNCKNKCKGC
QPCKPKLIIVHPNKPQDYYPQKWVCSCHNKIYNP

SEQ ID NO: 238 - Juniperus ashei (signal sequence is underlined)
<u>MSMKFMAALAFLALQLIVMAAGE</u>DQSAQIMLDSDTKQYHRSSRNLRKAVHHARHDVAIVFNVEHYGAVGDGKHDSTDAFE
KTWNAACNKLSAVFLVPANKKFVVNNLVFYGPCQPHFSFKVDGTIAAYPDPARWLNSKIWMHFARLTDFNLMGTGVIDGQ
GNRWWSDQCKTINGRTVCNDKGRPTAIKIDFSKSVTVKELTLTNSPEFHLVFGECDGVKIQGIKIKAPRDSPNTDGIDIF
ASKRFEIEKCTIGTGDDCVAVGTGSSNITIKDLTCGPGHGMSIGSLGKGNSRSEVSFVHLDGAKFIDTQNGLRIKTWQGG
SGLASHITYENVEMINAENPILINQFYCTSAAACKNQRSAVKIQDVTFKNIHGTSATTAAIQLMCSDSVPCSNIKLSNVF
LKLTSGKVATCVNKNANGYYTNPLNPSCKSLHPGRTPKELELHQKPTTLLMDEKMGASLNSSPPNCKNKCKGCQPCKPKL
IIVHPNQPEDYYPQRWVCSCHNKIYNP

SEQ ID NO: 239 - Hexalectris arizonica
HDVAIVFNVEHHGAVGDGNHDSTDAFEKTWNEACKTLSAVFLVPANKKFVVNNLVFYGPCQPHFSPKVDGIIAAYPDPV
KWKNSKIWMHFARLTDFNLMGTGVIDGQGSKWWSDQCKTVNGRTVCNDKGRPTAIKIDFSKSVTVKELTLMNSPEFHLVF
GECDGVKIQGIKIKAPKESPNTDGIDIFGSKRFEIEKCIIGTGDDCVAIGTGSSNITITDLTCGPGHGMSIGSLGKGNSR
SEVSFVHLDGAKFIDTQNGLRIKTWQGGSGLASHITYENVEMVNAENPILINQFYCSAACENQRSAVKIEDVWFKNIHG
TSATAAAIQLMCSDSVPCSNIKLSNVVLKLSSGKVAACVNKNANGYYTNPLNPPCKSLHPGPTP

SEQ ID NO: 240 - Juniperus ashei (signal sequence is underlined)
<u>MARVSELAFLLAATLAISLHMQEAG</u>VVKFDIKNQCGYTVWAAGLPGGGKRLDQGQTWTVNLAAGTASARFWGRTGCTFDA
SGKGSCQTGDCGGQLSCTVSGAVPATLAEYTQSDQDYYDVSLVDGFNIPLAINPTNAQCTAPACKADINAVCPSELKVDG
GCNSACNVFKTDQYCCRNAYVDNCPATNYSKIFKNQCPQAYSYAKDDTATFACASGTDYSIVFCP

SEQ ID NO: 241 - Juniperus rigida (signal sequence is underlined)
<u>MARVSELALLLVATLAISLHMQEAG</u>AVKFDIKNQCGYTVWAAGLPGGGKRLDQGQTWTLNLAAGTASARFWGRTGCTFDA
SGKGSCKTGDCGGQLSCTVSGAVPATLAEYTQSDQDYYDVSLVDGFNIPLAINPTNAQCTAPACKADINAVCPSELKVEG
GCNSACNVFQTDQYCCRNAYVDNCPATNYSKIFKNQCPQAYSYAKDDTATFACASGTDYSIVFCP

SEQ ID NO: 242 - Cupressus sempervirens (signal sequence is underlined)
<u>MARVSELALLLVATLAISLHMQEAG</u>AVKFDIKNQCGYTVWAAGLPGGGKRLDQGQTWTVNLAAGTASARFWGRTGCTFDA
SGKGSCRSGDCGGQLSCTVSGAVPATLAEYTQSDKDYYDVSLVDGFNIPLAINPTNTKCTAPACKADINAVCPSELKVDG
GCNSACNVLQTDQYCCRNAYVDNCPATNYSKIFKNQCPQAYSYAKDDTATFACASGTDYSIVFC

SEQ ID NO: 243 - Hesperocyparis arizonica
VKFDIKNQCGYTVWAAGLPGGGKEFDQGQTWTVNLAAGTASARFWGRTGCTFDASGKGSCRSGDCGGQLSCTVSGAVPAT
LAEYTQSDQDYYDVSLVDGFNIPLAINPTNTKCTAPACKADINAVCPSELKVDGGCNSACNVLQTDQYCCRNAYVNNCPA
TNYSKIFKNQCPQAYSYAKDDTATFACASGTDYSIVFCP

FIG. 14 (cont.)

SEQ ID NO: 244 - Pinus monticola (signal sequence is underlined)
<u>MGNSSGNSLMVLLLVLLLVGVTVNA</u>QNCGCASGLCCSQYGYCGSSSAYCGAGCKSGPCSGGGSPSGGGGSVGTIISQSFF
NGLAGGAASSCEGKGFYTYNAFIAAANAYSGFGTTGSADVTKRELAAFLANVMHGTGGMCYINERTPPMIYCMSSATWPC
ASGKSYHGRGPLQLSWNYNYGAAGQSIGFDGVNNPEKVGQDSTISFKTAVWFWMKNSNCHSAITSGQGFGGTIKAINSQE
CNGGNSGEVNSRVNYYKNICSQLGVDPGANLSCH

SEQ ID NO: 245 - Pseudotsuga menziesii (signal sequence is underlined)
<u>MGKTGGEKWVMALVLVLLLLGVSVNA</u>QNCGCASGLCCSKYGYCGTTSAYCGTGCRSGPCSSNSGGGSPSGGGGSVGTIIS
QSIFNGLAGGAASSCEGKGFYTYTAFIKAASAYSGFGTTGSNDVKKRELAAFFANVMHETGGLCYINERNPPMIYCNSSS
TWPCASGKSYHGRGPLQLSWNYNYGAAGKSIGFDGLNNPEKVGQDATISFKTAVWFWMNNSNCHSAITGGQGFGATIKAI
NSGECNGGNSGEVSSRVNYYRKICSQLGVDPGANVSC277

SEQ ID NO: 246 - Pinus taeda
MGSRSRILLIGATGYIGRHVAKASLDLGHPTFLLVRESTASSNSEKAQLLESFKASGANIVHGSIDDHASLVEAVKNVDV
VISTVGSLQIESQVNIIKAIKEVGTVKRFFPSEFGNDVDNVHAVEPAKSVFEVKAKVRRAIEAEGIPYTYVSSNCFAGYF
LRSLAQAGLTAPPRDKVVILGDGNARVVFVKEEDIGTFTIKAVDDPRTLNKTLYLRLPANTLSLNELVALWEKKIDKTLE
KAYVPEEEVLKLIADTPFPANISIAISHSIFVKGDQTNFEIGPAGVEASQLYPDVKYTTVDEYLSNFV

SEQ ID NO: 247 - Picea abies (signal sequence is underlined)
<u>MDSRRLKRSGIVCMVLMSMLMLVV</u>CEDSDNTACLSSLSSCAPYLNATTKPDSSCCSALISVIDKDSQCLCNLLNSDTVKQ
LGVNVTQAMKMPAECGKNVSATQCNKTATSGGSSVGKTPTSTPPPSSATPSTTTITKSNSNAAASVSVKMFPVAALVFVA
VASVLGLKGPCLR

FIG. 14 (cont.)

LAMP Detection

1---Ladder
2---Complete LAMP
3---ILC-1
4---ILC-4
5---Complete LAMP
6---ILC-1
7---ILC-4
8---Complete LAMP
9---ILC-1
10--ILC-4
11--LAMP Control 1---Ladder
2---Complete LAMP
3---ILC-1
4---ILC-4
5---Complete LAMP
6---ILC-1
7---ILC-4
8---Complete LAMP
9---ILC-1
10--ILC-4
11--LAMP Control LAMP Detection 1---Ladder
2---Cry J1Complete LAMP
3---Cry J2 Complete LAMP
4---Cry J1/J2 Complete LAMP
5---Cry J1/J2 ILC-4
6---LAMP Control

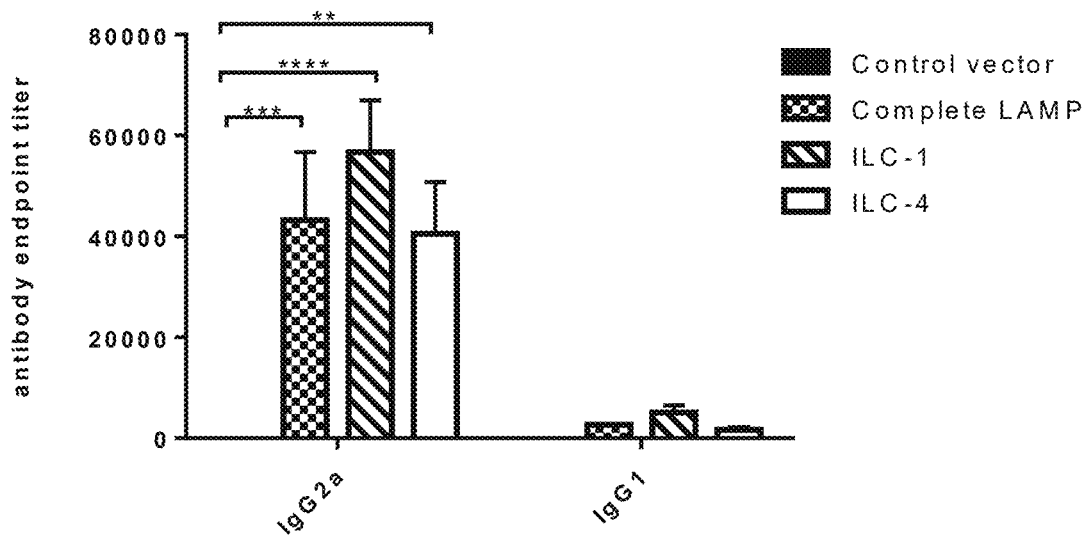
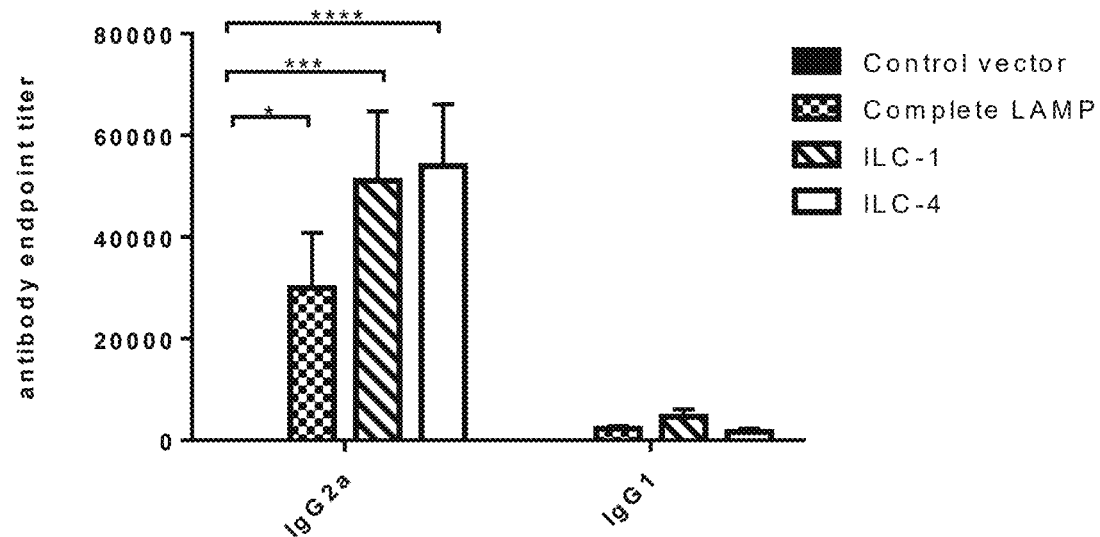
FIG. 16

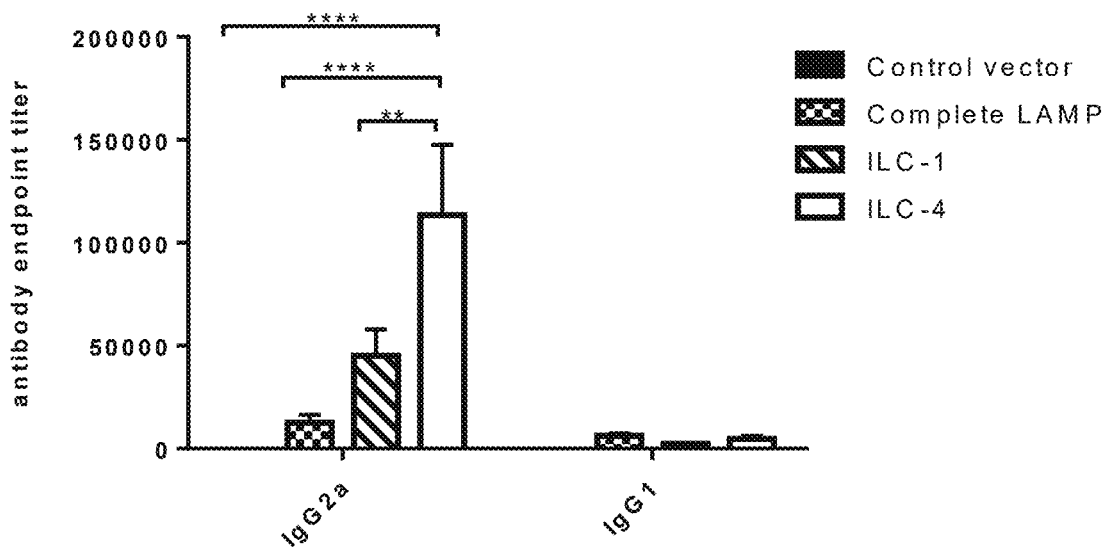
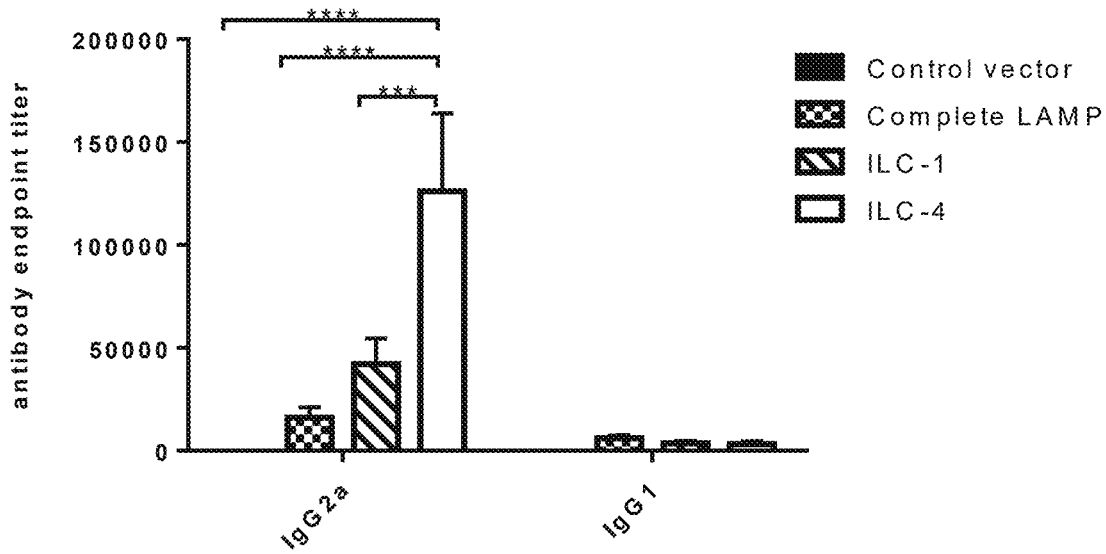
FIG. 17

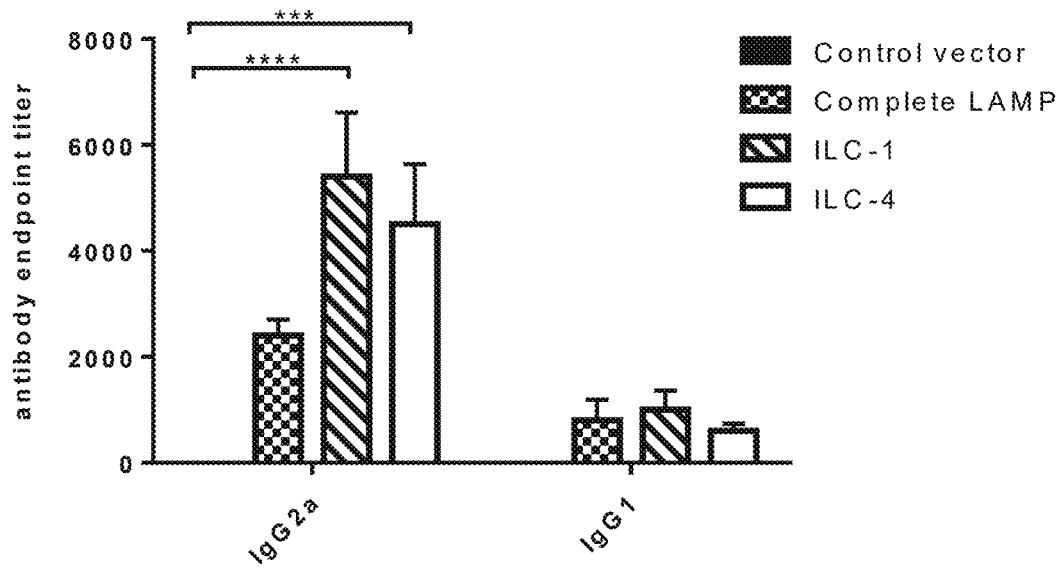
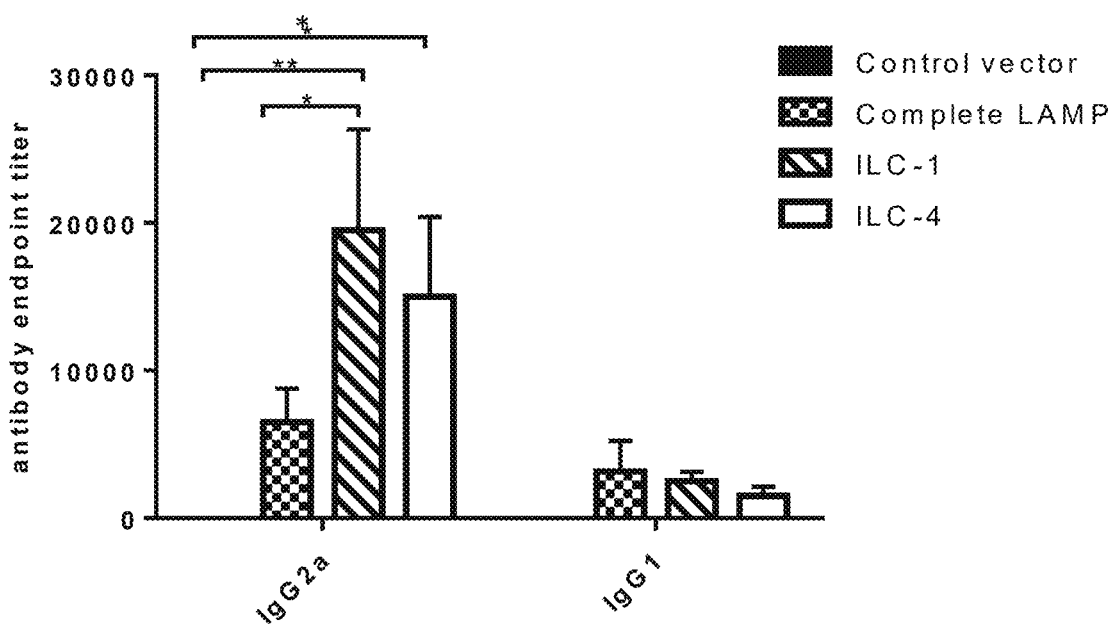
FIG. 18

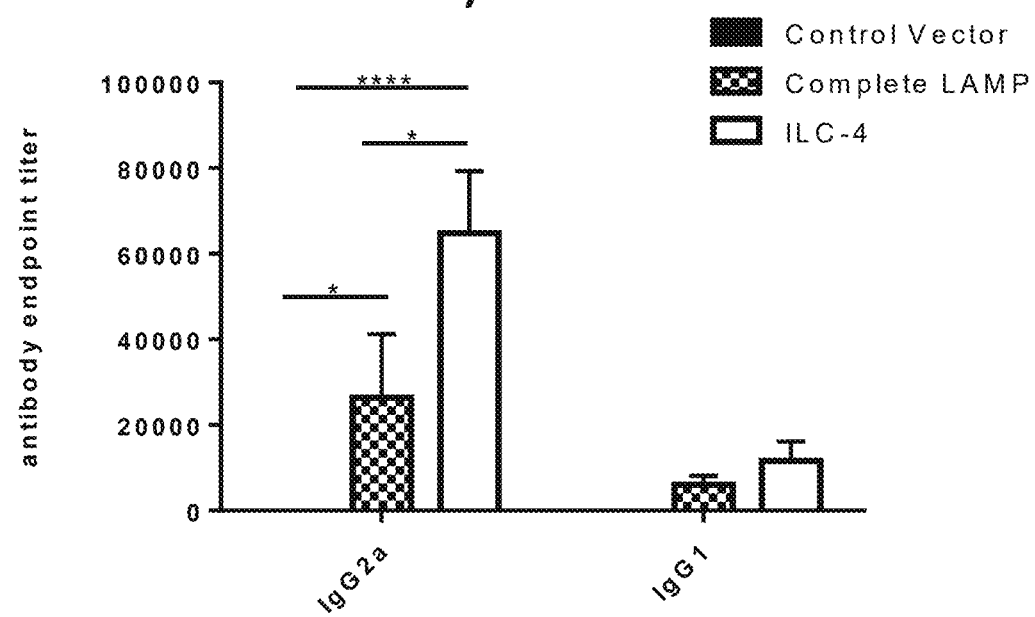
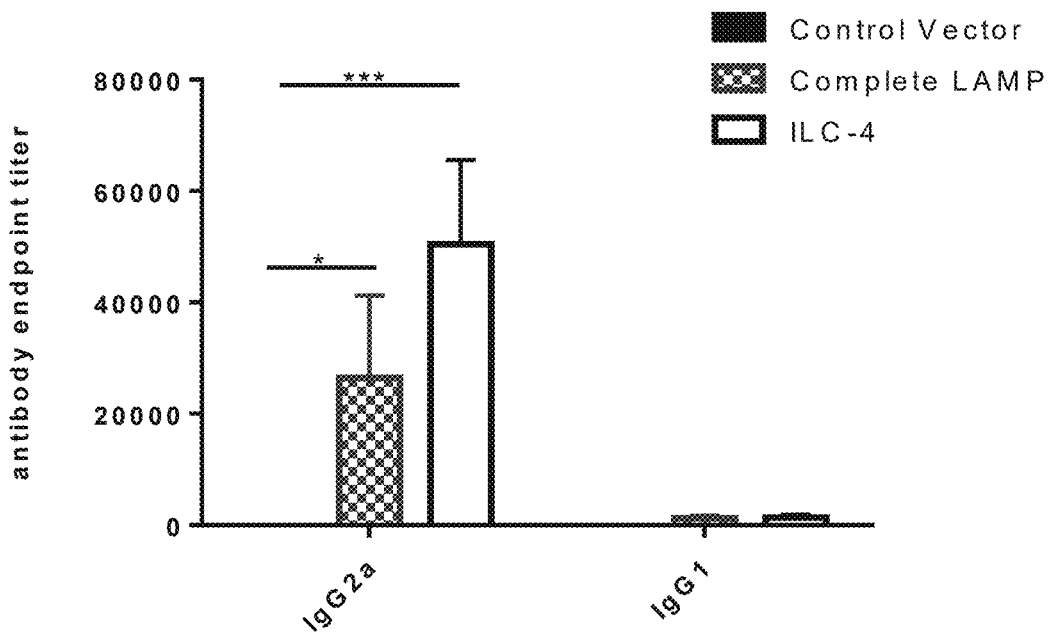
FIG. 19

LAMP CONSTRUCTS COMPRISING ALLERGENS

CROSS-REFERENCE TO RELATED APPLICATIONS

This application is a US National Stage application of PCT/US19/32305 filed May 14, 2019, which claims priority is U.S. Provisional Application 62/672,005 filed on May 15, 2018, U.S. Provisional Application 62/672,378 filed on May 16, 2018, and U.S. Provisional Application 62/673,932 filed on May 20, 2018; all of which are hereby incorporated by reference in their entirety.

BACKGROUND OF THE INVENTION

Sequence Listing

The present application contains a Sequence Listing which has been submitted in electronic format. The Sequence Listing, created on Dec. 20, 2023, is named "2023-12-20_01305-0013-OOUS_SL_Updated_ST25.txt" and is 639,432 bytes in size. The information in the electronic format of the Sequence Listing is incorporated herein by reference in its entirety.

Field of the Invention

The invention relates to improved LAMP Constructs comprising allergens and their use in treating subjects suffering from allergic reactions and/or allergies. More specifically, the invention relates to nucleic acids for use as DNA vaccines, and methods of using them to treat subjects suffering from or susceptible to allergic reactions. Prime boost protocols utilizing the improved LAMP Constructs described herein are also described.

DISCUSSION OF THE RELATED ART

In the following discussion, certain articles and methods will be described for background and introductory purposes. Nothing contained herein is to be construed as an "admission" of prior art. Applicant expressly reserves the right to demonstrate, where appropriate, that the articles and methods referenced herein do not constitute prior art under the applicable statutory provisions.

Allergic reactions occur when the immune system reacts to harmless foreign substances, called allergens. For example, food allergies are an important public health issue due to the high risk of anaphylaxis, a potentially deadly systemic shock (Sampson et al. (1992) N. Engl. J. Med. 327:380-384; Bock et al. (2001) J. Allergy Clin. Immunol. 107:191-193). Young children are at greater risk of developing food allergies than the general public (Lack et al. (2003) N. Engl. J. Med 348:977-985; Zimmerman et al. (1989) J. Allergy Clin. Immunol. 83:764-770; Green et al. (2007) Pediatrics 120:1304-1310). During the first three years of life, 6-8% of children experience an allergic reaction caused by food (Bock (1987) Allergy 45:587-596; Burks and Sampson (1993) Curr. Prob. Pediatr. 23:230-252; Jansen et al. (1994) J. Allergy Clin. Immunol. 93; 2:446-456; Sampson (1999) J. Allergy Clin. Immunol. 103; 5:717-728). Nut allergies, e.g., peanut and nut allergies, affect up to 1-2% of the population, and the rate of occurrence of this food allergy is thought to be increasing in the general population, disproportionately affecting those of Asian ethnicity.

Anaphylaxis caused by exposure to an allergen, e.g., tree nuts or peanuts, results in a severe immune reaction characterized by overproduction of histamine and is responsible for half of U.S. anaphylaxis emergency room visits annually. For example, extreme reactions to nuts result in over 30,000 incidents of anaphylaxis and between 100-200 deaths in the U.S. each year. Nuts in trace amounts are commonly found in thousands of individually branded, but not labeled, packaged food items. More than one and a half million Americans suffer symptoms from nut allergy and symptoms often persist throughout life. Many experience dangerous reactions on exposure to trace amounts.

There is no treatment for relieving nut allergy symptoms. Over the last ten years, the prevalence of nut allergies has doubled to affect 2% of adult Americans (Sampson (1999) J. Allergy Clin. Immunol. 103; 5:717-728; Sicherer et al. (2003) J. Allergy Clin. Immunol. 112:1203-1207). While the symptoms for many other allergies like hay fever and short ragweed pollen are not life threatening, for a nut allergic individual, the ingestion of as little as 1/1000th of a nut can induce anaphylactic shock and death (Taylor et al. (2002) J. Allergy Clin. Immunol. 109 (1):24-30; Wensing et al. (2002) J. Allergy Clin. Immunol. 110(6):915-920). In the event that accidental ingestion triggers anaphylaxis, injections of epinephrine are used to open up airway passages (Stark and Sullivan (1986) J. Allergy Clin. Immunol. 78:76-83; Sampson (2003) Pediatrics 111(6):1601-1608).

Food allergies occur when an individual fails to develop oral tolerance and instead becomes sensitized to subsequent allergen exposure (Till et al. (2004) J. Allergy Clin. Immunol. 113(6):1025-1034). In allergic patients, allergens preferentially activate type 2 helper CD4+T lymphocytes (Th2), which produce the pro-allergic cytokines interleukin IL-4, IL-5, and IL-13 that help orchestrate inflammation underlying most allergic symptoms (Woodfolk (2007) J. Allergy Clin. Immunol. 118(2):260-294). IL-4 instructs antibody-producing B cells to secrete allergen-specific Immunoglobulin (Ig) E (Del Prete et al. (1988) J. Immunol. 140:4193-4198; Swain et al. (1990) J. Immunol. 145:3796-3806). Unlike neutralizing IgG, IgE binds to its high affinity receptor Fc-εR1 expressed by mast cells and eosinophils (Blank et al. (1989) Nature 337:187-190; Benhamou et al. (1990) J. Immunol. 144:3071-3077), thus sensitizing these cells. Upon subsequent exposure, IgE binds the offending allergen, cross-links, and transduces a signal instructing mast cells to degranulate and release the volatile chemicals that trigger the allergic reaction.

Beside food allergies, other environmental agents can also generate an allergic response as described above in an individual. Examples of such environmental agents include, but are not limited to, pollen, dog dander, cat saliva, or dust mites.

Immunotherapy, the administration of increasing doses of an allergen to bring about tolerance, is a standard treatment for allergic diseases, but has not been approved for treating nut allergies due to frequent anaphylactic reactions (Nelson et al. (1997) J. Allergy Clin. Immunol 99; 6:744-751; Oppenheimer et al. (1992) J. Allergy Clin. Immunol 90:256-262). In addition, the utility of immunotherapy is limited by the length of treatment, which requires up to 36 months of weekly or bi-weekly injections and results in varying degrees of success and compliance (Bousquet et al. (1998) J. Allergy Clin. Immunol 102:558-562; Rank and Li (2007) Mayo Clin. Proc. 82(9):1119-1123; Ciprandi et al. (2007) Allergy Asthma Proc. 28:40-43).

DNA vaccines have been proposed as a treatment of allergic disease (Raz et al., 1996; Hartl et al., 2004; Hsu et al., 1996; Crameri 2007; Weiss et al., 2006). The underlying rationale is that allergen protein encoded by a DNA vaccine will preferentially activate the allergen-specific Th1 cellular response with the production of interferons by APCs, natural killer (NK), and T cells, rather than the characteristic Th2-type response, such as secretion of IL-4, IL-5, and IL-13, and the formation of IgE by B lymphocytes and the maturation and recruitment of eosinophils in late-phase reactions. However, the mechanisms underlying the differential induction of the Th1 and Th2 T-cell phenotypes appear to involve a large number of factors, such as unique properties of the bacterial DNA of vaccine preparations, e.g., unmethylated and CpG DNA residues, the cytokine milieu elicited by innate immunity, and the cellular trafficking properties of the allergens (Chen et al., 2001; Kaech et al., 2002).

DNA vaccines are new and promising candidates for the development of both prophylactic and therapeutic vaccines. They are proven to be safe and the lack of immune responses to a vector backbone may be a definitive advantage if repetitive cycles of vaccination are required to achieve clinical benefits. However, one perceived disadvantage of conventional DNA vaccines is their low immunogenicity in humans. A key limiting step in the immunogenicity of epitope-based DNA vaccines may be the access of epitopes to the MHCII presentation pathway to T cells, which is likely a stochastic process in the case of a vaccine without targeting technology.

U.S. Pat. No. 5,633,234 describes chimeric proteins comprising an antigenic domain of modified influenza hemagglutinin (HA) and a cytoplasmic endosomal/lysosomal targeting signal which effectively target antigens to that compartment. The antigenic domain was processed and peptides from it presented on the cell surface in association with major histocompatibility (MHC) class II molecules. The cytoplasmic tail of LAMP-1 was used to form the endosomal/lysosomal targeting domain of the chimeric protein.

U.S. Pat. No. 8,318,173 extended these initial observations to describe chimeric proteins (and the corresponding DNAs that encode these proteins) comprising the HIV-1 Gag protein inserted between the full lumenal domain and a transmembrane domain of LAMP-1. This construct was introduced into dendritic cells which were then reported to target the MHC II pathway.

This approach has proved useful in increasing cellular and humoral responses to several virus antigens, human papillomavirus E7, dengue virus membrane protein, HIV-1 gp160 membrane protein, HIV-1 p55 Gag, West Nile membrane protein, hepatitis C virus NS3 protein and cytomegalovirus pp65 (see, e.g., Bonini, et al., J. Immunol. 166: 5250-5257, 2001). The enhanced immune response can be attributed to co-localization of LAMP with MHC II and the more efficient processing and delivery of antigenic peptides. In addition, LAMP-targeting is reported to result in the presentation of an increased number of immunogenic epitopes, thus inducing a qualitatively broadened immune response compared to untargeted antigen. For example, Fernandes et al., 2000, Eur. J. Immunol. 30(8): 2333-43, demonstrated an increase in the number of presented peptides of a LAMP-trafficked OVA antigen encoded in a vaccinia vector. Of 12 peptides generated from exogenously supplied OVA, 9 were presented by an OVA/LAMP chimera, as compared to only 2 by the construct without LAMP.

While it has been determined that the cytoplasmic domain of LAMP is necessary (in conjunction with a signal sequence and transmembrane domain), it is not always sufficient for endosomal/lysosomal trafficking of all antigens. Instead, the full lumenal domain of LAMP has been shown to be also required for the trafficking of proteins to the lysosomal vesicular pathway.

However, even with the presence of the complete lumenal domain and the complete transmembrane/cytoplasmic tail of LAMP ("complete LAMP Constructs"), it has increasingly been found that the efficacy of a particular antigen to raise an immune response is highly dependent on the particular sequence used in these constructs. In fact, different antigenic fragments of the same protein when inserted into the complete LAMP constructs have been found to not elicit the same immune response. Sometimes the antigen fragment generates an immune response and other times it does not. These observations make the ability to predict ahead of time which particular antigenic sequence from a protein of interest will raise an immune response difficult with the complete LAMP Constructs.

Moreover, in generating the complete LAMP Constructs, it has been repeatedly observed that the full lumenal domain is required to properly express and process an antigen. For example, in Godinho et al., PLoS ONE 9(6): 9(6): e99887. doi:10.1371/journal.pone.0099887, the authors reported that the complete and intact lumenal domain was the necessary minimal region needed to target an antigen to the lysosomes and that fragments of the lumenal domain did not work. See, id. at page 6.

Specifically, the Godinho authors showed that by completely removing the first lumenal domain and some of the second lumenal domain (i.e., T1-Lum/gag construct), both protein expression and antibody response is decreased. Similarly, removing 25% of first lumenal domain but having an intact second lumenal domain (i.e., T2-lum/gag), both protein expression and antibody response comparatively increased but still less than the results obtained with the complete LAMP construct.

Moreover, the authors acknowledged that the ability to raise an immune response is dependent upon the particular antigen and the epitopes used in these complete LAMP Constructs. For example, on page 9, column 2, the authors state "accordingly, previous studies demonstrated that DNA vaccines that generate Gag secreted as VLP, or in a soluble form, induce different levels of T and B cell activation, which were also different from the response induced by cytoplasmic Gag." Moreover, insertion of an antigenic sequence between the full lumenal domain of LAMP and the full transmembrane/cytoplasmic domain of LAMP as has been described in the literature can result in such large polynucleotide sequences that it can become either too costly to produce at commercial levels or impractical from a scientific perspective.

Thus, there is a need to design new and improved LAMP Constructs that can be used as vaccines to effectively treat, for example, allergic reactions and/or allergies. Moreover, once improved, these new LAMP Constructs can be used to generate antibodies directed to the allergens as described herein.

SUMMARY OF THE INVENTION

This Summary is provided to introduce a selection of concepts in a simplified form that are further described below in the Detailed Description. This Summary is not intended to identify key or essential features of the claimed subject matter, nor is it intended to be used to limit the scope of the claimed subject matter. Other features, details, utilities, and advantages of the claimed subject matter will be apparent from the following written Detailed Description including those aspects illustrated in the accompanying drawings and defined in the appended claims.

It is an object of this invention to provide novel constructs ("improved LAMP Constructs") comprising specific fragments and/or variants of LAMP domains that effectively present the allergens specified herein to the immune system to generate an enhanced immune response. These improved LAMP Constructs effectively direct the allergens to the lysosomal/endosomal compartment where they are processed and presented to major histocompatibility complex (MHC) class II molecules so that helper T cells are preferentially stimulated and/or antibodies are generated.

The improved LAMP Constructs and methods described herein may elicit an immune response in a subject. The immune response may be an immune response to the epitopes of the Allergen X (SEQ ID NO:Y) in the improved LAMP Construct (e.g., vaccine). Vaccines arm the immune system of the subject such that the immune system may detect and destroy that which contains the Allergen X (SEQ ID NO:Y) of the vaccines in the subject. The improved LAMP Constructs and methods described herein may elicit a Th1 immune response in the subject. Th1 immune responses may include secretion of inflammatory cytokines (e.g., IFNγ, TNFα) by a subset of immune cells (e.g., allergen specific T-cells).

In some cases, the Allergen X (SEQ ID NO:Y) used in the improved LAMP Constructs and methods described herein may be recognized by the immune system of a subject to elicit a Th1 immune response and release Type I cytokines. The Th1 response may be initiated by the interaction between the epitope and the T-cell, more specifically, the major histocompatibility complex (MHC) expressed by the T-cell. For example, high affinity binding of an epitope to an MHC receptor may stimulate a Th1 response. MHC receptors may be at least one of a plurality of types of MHC receptors. The MHC receptors engaged on a T-cell may vary across individuals in a population.

In some cases, the immune response is a Type 1 immune response. In some cases, the immune response is characterized by a ratio of Type I cytokine production to Type II cytokine production that is greater than 1. In some cases, the immune response is characterized by a ratio of Type I cytokine production to Type II cytokine production that is less than 1. In some cases, the immune response is characterized by a ratio of IFNγ production to IL-10 production that is greater than 1. In some cases, the immune response is characterized by a ratio of IFNγ production to IL-10 production that is less than 1.

Prime boost protocols are also contemplated. For example, the invention further provides a method for generating an immune response in a subject to an Allergen X (SEQ ID NO:Y), comprising priming the subject with an improved LAMP Construct comprising an Allergen X (SEQ ID NO:Y) as described herein followed by at least one boosting of the subject with the allergen or a related allergen (e.g., a second allergen derived from the same or highly similar protein sequence). Mixtures of allergens can be used in either or both the priming and the boosting step. Use of an improved LAMP Construct for the prime step followed by an Allergen X (SEQ ID NO:Y) boost step has been shown to significantly produce higher titers, indicating the power of LAMP in enhancing antibody response.

The invention further provides a nucleic acid molecule encoding any of the improved LAMP Constructs comprising the Allergen X (SEQ ID NO:Y) described herein. The improved LAMP Construct can comprise a nucleic acid wherein the nucleic acid molecule is operably linked to an expression control sequence. In one preferred aspect, the improved LAMP Construct is a vaccine vector, suitable for vaccinating a patient. In another aspect, the invention provides a delivery vehicle comprising the improved LAMP Construct for facilitating the introduction of the nucleic acid molecule encoding the allergen into a cell. The delivery vehicle may be lipid-based (e.g., a liposome formulation), viral-based (e.g., comprising viral proteins encapsulating the nucleic acid molecule), or cell-based.

In preferred embodiments, the invention provides an injectable composition comprising an improved LAMP Construct comprising an Allergen X (SEQ ID NO:Y) of interest for eliciting an immune response (e.g., generation of antibodies) in a mammal to the allergen. In preferred embodiments, this vaccine generates a preferential Th1 response to a Th2 response. The improved LAMP Constructs comprise at least one epitope of an Allergen X (SEQ ID NO:Y) as described herein.

The invention also provides a cell comprising any of the improved LAMP Constructs described herein. In one aspect, the cell is an antigen presenting cell. The antigen presenting cell may be a professional antigen presenting cell (e.g., a dendritic cell, macrophage, B cell, and the like) or an engineered antigen presenting cell (e.g., a non-professional antigen presenting cell engineered to express molecules required for antigen presentation, such as MHC class II molecules). The molecules required for antigen presentation may be derived from other cells, e.g., naturally occurring, or may themselves be engineered (e.g. mutated or modified to express desired properties, such as higher or lower affinity for an allergenic epitope). In one aspect, the antigen presenting cell does not express any co-stimulatory signals.

The invention additionally provides a kit comprising a plurality of cells comprising any of the improved LAMP Constructs described herein. At least two of the cells express different MHC class II molecules, and each cell comprises the same LAMP Construct. In one aspect, a kit is provided comprising an improved LAMP Construct and a cell for receiving the vector.

The invention also provides a transgenic animal comprising at least one of the cells and/or at least one of the improved LAMP Constructs described herein. The invention also provides a transgenic animal comprising at least one of the cells described herein.

The invention further provides a method for generating an immune response in an animal (e.g., a human or a non-human vertebrate) to an Allergen X (SEQ ID NO:Y), comprising: administering to the animal a cell as described above, wherein the cell expresses, or can be induced to express, the improved LAMP Construct in the animal. In one aspect, the cell comprises an MHC class II molecule compatible with MHC proteins of the animal, such that the animal does not generate an immune response against the MHC class II molecule. In one preferred aspect, the animal is a human.

In one further aspect, the invention provides a method for eliciting an immune response to an Allergen X (SEQ ID NO:Y), comprising administering to an animal, such as a human or a non-human vertebrate, any of the improved LAMP Constructs described herein. Preferably, the improved LAMP Construct is infectious for a cell of the animal. For example, the improved LAMP Construct may be a viral vector, such as a vaccinia improved LAMP Construct.

For example, the invention further provides a method for generating an immune response in an animal to an Allergen X (SEQ ID NO:Y), comprising priming the animal with an improved LAMP Construct comprising an Allergen X (SEQ ID NO:Y) as described herein followed by at least one boosting of the animal. Use of an improved LAMP Construct for the prime step followed by an Allergen X (SEQ ID NO:Y) boost step has been shown to significantly produce higher titers, indicating the power of LAMP in enhancing antibody response.

In a further aspect, a cell is obtained from a patient, the improved LAMP Construct described herein is introduced into the cell and the cell or progeny of the cell is reintroduced into the patient. In one aspect, the cell is a stem cell-capable of differentiating into an antigen presenting cell. Treatments of human patients as well as veterinary use are specifically contemplated.

Specifically, by combining presentation of the allergen of interest with LAMP, the allergen is then effectively transported to the cytoplasmic endosomal/lysosomal compartments, where the allergen can be processed and peptides from it presented on the cell surface in association with major histocompatibility (MHC) class II molecules.

These and other aspects, objects and features are described in more detail below.

BRIEF DESCRIPTION OF THE FIGURES

The objects and features of the invention can be better understood with reference to the following detailed description and accompanying drawings.

FIG. 1 illustrates the general scheme of different types of improved LAMP Constructs (identified as ILC-1, ILC-2, ILC-3, ILC-4, ILC-5 and ILC-6) that can be used as described herein.

FIG. 2B illustrates the domains of the LAMP proteins defined herein while FIG. 2A defines the specific amino acid boundaries of these domains for human LAMP-1 (SEQ ID NO: 1), human LAMP-2 (SEQ ID NO:2), human LAMP-3 (SEQ ID NO:3), human LIMP-2 (SEQ ID NO:4), human Endolyn (SEQ ID NO:5), human Macrosailin (SEQ ID NO:80), human LAMP-5 (SEQ ID NO:93) and human LIMBIC (SEQ ID NO: 67). As described herein the LAMP lumenal domains, homology domains, transmembrane domains, the cytoplasmic tail and the signal sequences can be used to generate the improved LAMP Constructs ILC-1, ILC-2, ILC-3, ILC-4, ILC-5 and ILC-6 as described herein.

FIG. 3 provides alignment of LAMP-1 proteins found in other species as compared to human LAMP-1 (SEQ ID NO: 1). The equivalent domains of these other species can be used to generate the improved LAMP Constructs described herein and are readily identifiable by comparing the domains identified for human LAMP-1 in FIG. 2 and FIG. 3 to the alignments shown in FIG. 3.

FIG. 4 provides alignment of LAMP-2 proteins found in other species as compared to human LAMP-2 (SEQ ID NO:2). The equivalent domains of these other species can be used to generate the improved LAMP Constructs described herein and are readily identifiable by comparing the domains identified for human LAMP-2 in FIG. 2 and FIG. 4 to the alignments shown in FIG. 4.

FIG. 5 provides alignment of LAMP-3 proteins found in other species as compared to human LAMP-3 (SEQ ID NO:3). The equivalent domains of these other species can be used to generate the improved LAMP Constructs described herein and are readily identifiable by comparing the domains identified for human LAMP-3 in FIG. 2 and FIG. 5 to the alignments shown in FIG. 5.

FIG. 6 provides alignment of LIMP-2 proteins found in other species as compared to human LIMP-2 (SEQ ID NO:4). The equivalent domains of these other species can be used to generate the improved LAMP Constructs described herein and are readily identifiable by comparing the domains identified for human LIMP-2 in FIG. 2 and FIG. 6 to the alignments shown in FIG. 6.

FIG. 7 provides alignment of LIMBIC proteins found in other species as compared to human LIMBIC (SEQ ID NO:67). The equivalent domains of these other species can be used to generate the improved LAMP Constructs described herein and are readily identifiable by comparing the domains identified for human LIMBIC in FIG. 2 and FIG. 7 to the alignments shown in FIG. 7.

FIG. 8 provides alignment of Endolyn proteins found in other species as compared to human Endolyn (SEQ ID NO:5). The equivalent domains of these other species can be used to generate the improved LAMP Constructs described herein and are readily identifiable by comparing the domains identified for human Endolyn in FIG. 2 and FIG. 8 to the alignments shown in FIG. 8.

FIG. 9 provides alignment of Macrosailin proteins found in other species as compared to human Macrosailin (SEQ ID NO:80). The equivalent domains of these other species can be used to generate the improved LAMP Constructs described herein and are readily identifiable by comparing the domains identified for human Macrosailin in FIG. 2 and FIG. 9 to the alignments shown in FIG. 9.

FIG. 10 provides alignment of LAMP-5 proteins found in other species as compared to human LAMP-5 (SEQ ID NO:93). The equivalent domains of these other species can be used to generate the improved LAMP Constructs described herein and are readily identifiable by comparing the domains identified for human LAMP-5 in FIG. 2 and FIG. 10 to the alignments shown in FIG. 10.

FIG. 11 shows results obtained when mice were immunized with HVEM-LAMP, HVEM, or LAMP on day 0, 7, and 14. On day 28, mice were bled and serum samples were isolated. HVEM specific IgG was examined by ELISA. Data represent geometric mean of antibody titers±geometric SD, n=6. ** p value <0.01

FIG. 12 shows results obtained when mice were immunized with HVEM-LAMP, HVEM, or LAMP on day 0, 7, and 14. On day 35, mice were boosted with 5 μg HVEM protein in the presence of alum adjuvant. Mice were bled on day 49 and serum samples were isolated. HVEM specific IgG was examined by ELISA. Data represent geometric mean of antibody titers±geometric SD, n=6. * p value <0.001; ** p value <0.0001.

FIG. 13 shows that LAMP alters the binding affinity of epitopes in CRD3/4 of HVEM.

FIG. 14 is a schematic representation of the different constructs described herein as provided as Table 1/FIG. 14.

FIG. 15A and FIG. 15B is a Western Blot of allergens Amb a 1, Bet v 1, Fel d 4 expressed from different LAMP constructs and FIG. 15C is a Western Blot of allergen Cry J1/Cry J2. Protein expression for each allergen was demonstrated with anti-LAMP antibody (FIG. 15A and FIG. 15C). GAPDH detection was used to demonstrate equal loading between lanes (FIG. 15B).

FIG. 16 shows the results of Amb a 1 specific IgG ELISA.

FIG. 17 shows the results of Bet v 1 specific IgG ELISA.

FIG. 18 shows the results of Fel d 4 specific IgG ELISA

FIG. 19 shows the results of Cry J 1 specific IgG ELISA.

DETAILED DESCRIPTION

The invention provides improved LAMP Constructs which can be used to generate vaccines. The improved LAMP Constructs can be used to modulate or enhance an immune response. In one preferred aspect, the invention provides a method for treating a patient with allergies and/or an allergic response by providing an improved LAMP Construct comprising one or more of the Allergen X (SEQ ID NO.Y) as described herein.

Definitions

The following definitions are provided for specific terms which are used in the following written description.

As used in the specification and claims, the singular form "a", "an" and "the" include plural references unless the context clearly dictates otherwise. For example, the term "a cell" includes a plurality of cells, including mixtures thereof. The term "a nucleic acid molecule" includes a plurality of nucleic acid molecules.

As used herein, the term "comprising" is intended to mean that the improved LAMP Constructs and methods include the recited elements, but do not exclude other elements. "Consisting essentially of", when used to define improved LAMP Constructs and methods, shall mean excluding other elements of any essential significance to the combination. Thus, an improved LAMP Construct consisting essentially of the elements as defined herein would not exclude trace contaminants from the isolation and purification method and pharmaceutically acceptable carriers, such as phosphate buffered saline, preservatives, and the like. "Consisting of" shall mean excluding more than trace elements of other ingredients and substantial method steps for administering the improved LAMP Constructs of this invention. Embodiments defined by each of these transition terms are within the scope of this invention.

The term "about" or "approximately" means within an acceptable range for the particular value as determined by one of ordinary skill in the art, which will depend in part on how the value is measured or determined, e.g., the limitations of the measurement system. For example, "about" can mean a range of up to 20%, preferably up to 10%, more preferably up to 5%, and more preferably still up to 1% of a given value. Alternatively, particularly with respect to biological systems or processes, the term can mean within an order of magnitude, preferably within 5 fold, and more preferably within 2 fold, of a value. Unless otherwise stated, the term 'about' means within an acceptable error range for the particular value, such as ±1-20%, preferably ±1-10% and more preferably ±1-5%.

Where a range of values is provided, it is understood that each intervening value, between the upper and lower limit of that range and any other stated or intervening value in that stated range is encompassed within the invention. The upper and lower limits of these smaller ranges may independently be included in the smaller ranges, and are also encompassed within the invention, subject to any specifically excluded limit in the stated range. Where the stated range includes one or both of the limits, ranges excluding either both of those included limits are also included in the invention.

As used herein, "the lysosomal/endosomal compartment" refers to membrane-bound acidic vacuoles containing LAMP molecules in the membrane, hydrolytic enzymes that function in antigen processing, and MHC class II molecules for antigen recognition and presentation. This compartment functions as a site for degradation of foreign materials internalized from the cell surface by any of a variety of mechanisms including endocytosis, phagocytosis and pinocytosis, and of intracellular material delivered to this compartment by specialized autolytic phenomena (de Duve, Eur. J. Biochem. 137: 391, 1983). The term "endosome" as used herein and in the claims encompasses a lysosome.

As used herein, a "lysosome-related organelle" refers to any organelle which comprises lysosymes and includes, but is not limited to, MIIC, CIIV, melanosomes, secretory granules, lytic granules, platelet-dense granules, basophil granules, Birbeck granules, phagolysosomes, secretory lysosomes, and the like. Preferably, such an organelle lacks mannose 6-phosphate receptors and comprises LAMP, but may or may not comprise an MHC class II molecule. For reviews, see, e.g., Blott and Griffiths, Nature Reviews, Molecular Cell Biology, 2002; Dell'Angelica, et al., The FASEB Journal 14: 1265-1278, 2000.

As used herein, the terms "polynucleotide" and "nucleic acid molecule" are used interchangeably to refer to polymeric forms of nucleotides of any length. The polynucleotides may contain deoxyribonucleotides, ribonucleotides, and/or their analogs. Nucleotides may have any three-dimensional structure, and may perform any function, known or unknown. The term "polynucleotide" includes, for example, single-, double-stranded and triple helical molecules, a gene or gene fragment, exons, introns, mRNA, tRNA, rRNA, ribozymes, antisense molecules, cDNA, recombinant polynucleotides, branched polynucleotides, aptamers, plasmids, vectors, isolated DNA of any sequence, isolated RNA of any sequence, nucleic acid probes, and primers. A nucleic acid molecule may also comprise modified nucleic acid molecules (e.g., comprising modified bases, sugars, and/or internucleotide linkers).

As used herein, the term "peptide" refers to a compound of two or more subunit amino acids, amino acid analogs, or peptidomimetics. The subunits may be linked by peptide bonds or by other bonds (e.g., as esters, ethers, and the like).

As used herein, the term "amino acid" refers to either natural and/or unnatural or synthetic amino acids, including glycine and both D or L optical isomers, and amino acid analogs and peptidomimetics. A peptide of three or more amino acids is commonly called an oligopeptide if the peptide chain is short. If the peptide chain is long (e.g., greater than about 10 amino acids), the peptide is commonly called a polypeptide or a protein. While the term "protein" encompasses the term "polypeptide", a "polypeptide" may be a less than full-length protein.

As used herein a "LAMP polypeptide" refers to the mammalian lysosomal associated membrane proteins human LAMP-1, human LAMP-2, human LAMP-3, human LIMP-2, human Endolyn, human LIMBIC, human LAMP-5, or human Macrosailin as described herein, as well as orthologs (such as, for example, the LAMP proteins shown in FIGS. 3-10), and allelic variants. As used herein, "expression" refers to the process by which polynucleotides are transcribed into mRNA and/or translated into peptides, polypeptides, or proteins. If the polynucleotide is derived from genomic DNA, expression may include splicing of the mRNA transcribed from the genomic DNA.

As used herein, "under transcriptional control" or "operably linked" refers to expression (e.g., transcription or translation) of a polynucleotide sequence which is controlled by an appropriate juxtaposition of an expression control element and a coding sequence. In one aspect, a DNA sequence is "operatively linked" to an expression control sequence when the expression control sequence controls and regulates the transcription of that DNA sequence.

As used herein, "coding sequence" is a sequence which is transcribed and translated into a polypeptide when placed under the control of appropriate expression control sequences. The boundaries of a coding sequence are determined by a start codon at the 5' (amino) terminus and a translation stop codon at the 3' (carboxyl) terminus. A coding sequence can include, but is not limited to, a prokaryotic sequence, cDNA from eukaryotic mRNA, a genomic DNA sequence from eukaryotic (e.g., mammalian) DNA, and even synthetic DNA sequences. A polyadenylation signal and transcription termination sequence will usually be located 3' to the coding sequence.

As used herein, two coding sequences "correspond" to each other if the sequences or their complementary sequences encode the same amino acid sequences.

As used herein, "signal sequence" denotes the endoplasmic reticulum translocation sequence. This sequence encodes a signal peptide that communicates to a cell to direct a polypeptide to which it is linked (e.g., via a chemical bond) to an endoplasmic reticulum vesicular compartment, to enter an exocytic/endocytic organelle, to be delivered either to a cellular vesicular compartment, the cell surface or to secrete the polypeptide. This signal sequence is sometimes clipped off by the cell in the maturation of a protein. Signal sequences can be found associated with a variety of proteins native to prokaryotes and eukaryotes.

As used herein, "trafficking" denotes movement or progression of the polypeptide encoded by the improved LAMP Construct through cellular organelles or compartments in the pathway from the rough endoplasmic reticulum to the endosomal/lysosomal compartment or related organelles where antigen processing and binding to MHC II occurs.

Short stretches of polynucleotides that encode amino acids may be included at the ends of the polynucleotides that encode Allergen X to facilitate cloning into any of the vectors described herein. For example, use of cloning sequences that flank the amino acid sequence of SEQ ID NO:Y, such as, for example, polynucleotides that encode "Leu-Glu" and "Glu-Phe" (e.g., "CTCGAG" and "GAATTC") may be included in the construct design.

As used herein, an "improved LAMP Construct" and an "improved LAMP Construct comprising an Allergen X (SEQ ID NO:Y)" and an "improved LAMP Construct comprising an allergen of interest" are used interchangeably. The different arrangements of the improved LAMP Constructs are illustrated in FIG. 1 as ILC1-ILC6. Moreover, the use of an "improved LAMP Construct" encompasses both the polynucleotide sequence of the improved LAMP Construct (which comprises a polynucleotide encoding Allergen X (SEQ ID NO:Y) as well as the protein encoded by the polynucleotide sequence of the improved LAMP Construct.

As used herein, an "improved LAMP Construct delivery vehicle" is defined as any molecule or group of molecules or macromolecules that can carry an improved LAMP Construct into a host cell (e.g., such as genes or gene fragments, antisense molecules, ribozymes, aptamers, and the like) and which occurs in association with an improved LAMP Construct as described herein.

As used herein, "improved LAMP Construct delivery," or "improved LAMP Construct transfer," refers to the introduction of the improved LAMP Construct into a host cell, irrespective of the method used for the introduction. The introduced improved LAMP Constructs may be stably or transiently maintained in the host cell. Stable maintenance typically requires that the introduced improved LAMP Construct either contains an origin of replication compatible with the host cell or integrates into a replicon of the host cell such as an extrachromosomal replicon (e.g., a plasmid) or a nuclear or mitochondrial chromosome.

As used herein, a "viral improved LAMP Construct" refers to a virus or viral particle that comprises the improved LAMP Construct to be delivered into a host cell, either in vivo, ex vivo or in vitro. Examples of viral improved LAMP Constructs include, but are not limited to, adenovirus vectors, adeno-associated virus vectors, retroviral vectors, and the like. In aspects where gene transfer is mediated by an adenoviral vector, an improved LAMP Construct includes the adenovirus genome or part thereof, and a selected, non-adenoviral gene, in association with adenoviral capsid proteins.

As used herein, "adenoviral-mediated gene transfer" or "adenoviral transduction" refers to the process by which an improved LAMP Construct is transferred into a host cell by virtue of the adenovirus entering the cell. Preferably, the improved LAMP Construct is able to replicate and/or integrate and be transcribed within the cell.

As used herein, "adenovirus particles" are individual adenovirus virions comprised of an external capsid and an improved LAMP Construct, where the capsid is further comprised of adenovirus envelope proteins. The adenovirus envelope proteins may be modified to comprise a fusion polypeptide which contains a polypeptide ligand covalently attached to the viral protein, e.g., for targeting the adenoviral particle to a particular cell and/or tissue type.

As used herein, the term "administering" or "immunizing" or "injecting" an improved LAMP Construct refers to transducing, transfecting, microinjecting, electroporating, or shooting the cell with the improved LAMP Construct. In some aspects, improved LAMP Constructs are introduced into a target cell by contacting the target cell with a delivery cell (e.g., by cell fusion or by lysing the delivery cell when it is in proximity to the target cell).

As used herein, the phrase "prime boost" describes the use of an improved LAMP Construct comprising an Allergen X (SEQ ID NO:Y) described herein used to prime a T-cell response followed by the use of a second improved LAMP Construct comprising an Allergen X (SEQ ID NO:Y), a DNA vaccine comprising an Allergen X (SEQ ID NO:Y) or a recombinant allergen to boost the response (or visa versa). These heterologous prime-boost immunizations elicit immune responses of greater height and breadth than can be achieved by priming and boosting with the same vector. The priming with an improved LAMP Construct comprising an Allergen X (SEQ ID NO:Y) initiates memory cells; the boost step expands the memory response. Preferably, two different agents that do not raise responses against each other are used and thus do not interfere with each other's activity. Mixtures of allergens are specifically contemplated in the prime and/or boost step. Boosting can occur once or multiple times.

As used herein, "hybridization" refers to a reaction in which one or more polynucleotides react to form a complex that is stabilized via hydrogen bonding between the bases of the nucleotide residues. The hydrogen bonding may occur by Watson-Crick base pairing, Hoogstein binding, or in any other sequence-specific manner. The complex may comprise two strands forming a duplex structure, three or more strands forming a multi-stranded complex, a single self-hybridizing strand, or any combination of these. A hybridization reaction may constitute a step in a more extensive process, such as the initiation of a PCR reaction, or the enzymatic cleavage of a polynucleotide by a ribozyme.

As used herein, a polynucleotide or polynucleotide region (or a polypeptide or polypeptide region) which has a certain percentage (for example, at least about 50%, at least about 60%, at least about 70%, at least about 80%, at least about 85%, at least about 90%, at least about 95%, at least about 99%) of "sequence identity" to another sequence means that, when maximally aligned, using software programs routine in the art, that percentage of bases (or amino acids) are the same in comparing the two sequences.

Two sequences are "substantially homologous" or "substantially similar" when at least about 50%, at least about 60%, at least about 70%, at least about 75%, and preferably at least about 80%, and most preferably at least about 90 or 95% of the nucleotides match over the defined length of the DNA sequences. Similarly, two polypeptide sequences are "substantially homologous" or "substantially similar" when at least about 50%, at least about 60%, at least about 66%, at least about 70%, at least about 75%, and preferably at least about 80%, and most preferably at least about 90 or 95% of the amino acid residues of the polypeptide match over a defined length of the polypeptide sequence. Sequences that are substantially homologous can be identified by comparing the sequences using standard software available in sequence data banks. Substantially homologous nucleic acid sequences also can be identified in a Southern hybridization experiment under, for example, stringent conditions as defined for that particular system. Defining appropriate hybridization conditions is within the skill of the art. For example, stringent conditions can be: hybridization at 5×SSC and 50% formamide at 42° C., and washing at 0.1×SSC and 0.1% sodium dodecyl sulfate at 60° C. Further examples of stringent hybridization conditions include: incubation temperatures of about 25 degrees C. to about 37 degrees C.; hybridization buffer concentrations of about 6×SSC to about 10×SSC; formamide concentrations of about 0% to about 25%; and wash solutions of about 6×SSC. Examples of moderate hybridization conditions include: incubation temperatures of about 40 degrees C. to about 50 degrees C.; buffer concentrations of about 9×SSC to about 2×SSC; formamide concentrations of about 30% to about 50%; and wash solutions of about 5×SSC to about 2×SSC. Examples of high stringency conditions include: incubation temperatures of about 55 degrees C. to about 68 degrees C.; buffer concentrations of about 1×SSC to about 0.1×SSC; formamide concentrations of about 55% to about 75%; and wash solutions of about 1×SSC, 0.1×SSC, or deionized water. In general, hybridization incubation times are from 5 minutes to 24 hours, with 1, 2, or more washing steps, and wash incubation times are about 1, 2, or 15 minutes. SSC is 0.15 M NaCl and 15 mM citrate buffer. It is understood that equivalents of SSC using other buffer systems can be employed. Similarity can be verified by sequencing, but preferably, is also or alternatively, verified by function (e.g., ability to traffic to an endosomal compartment, and the like), using assays suitable for the particular domain in question.

The terms "percent (%) sequence similarity", "percent (%) sequence identity", and the like, generally refer to the degree of identity or correspondence between different nucleotide sequences of nucleic acid molecules or amino acid sequences of polypeptides that may or may not share a common evolutionary origin (see Reeck et al., supra). Sequence identity can be determined using any of a number of publicly available sequence comparison algorithms, such as BLAST, FASTA, DNA Strider, GCG (Genetics Computer Group, Program Manual for the GCG Package, Version 7, Madison, Wisconsin), etc.

To determine the percent identity between two amino acid sequences or two nucleic acid molecules, the sequences are aligned for optimal comparison purposes. The percent identity between the two sequences is a function of the number of identical positions shared by the sequences (i.e., percent identity=number of identical positions/total number of positions (e.g., overlapping positions)×100). In one embodiment, the two sequences are, or are about, of the same length. The percent identity between two sequences can be determined using techniques similar to those described below, with or without allowing gaps. In calculating percent sequence identity, typically exact matches are counted.

The determination of percent identity between two sequences can be accomplished using a mathematical algorithm. A non-limiting example of a mathematical algorithm utilized for the comparison of two sequences is the algorithm of Karlin and Altschul, Proc. Natl. Acad. Sci. USA 1990, 87:2264, modified as in Karlin and Altschul, Proc. Natl. Acad. Sci. USA 1993, 90:5873-5877. Such an algorithm is incorporated into the NBLAST and XBLAST programs of Altschul et al, J. Mol. Biol. 1990; 215: 403. BLAST nucleotide searches can be performed with the NBLAST program, score=100, wordlength=12, to obtain nucleotide sequences homologous to sequences of the invention. BLAST protein searches can be performed with the XBLAST program, score=50, wordlength=3, to obtain amino acid sequences homologous to protein sequences of the invention. To obtain gapped alignments for comparison purposes, Gapped BLAST can be utilized as described in Altschul et al, Nucleic Acids Res. 1997, 25:3389. Alternatively, PSI-Blast can be used to perform an iterated search that detects distant relationship between molecules. See Altschul et al. (1997) supra. When utilizing BLAST, Gapped BLAST, and PSI-Blast programs, the default parameters of the respective programs (e.g., XBLAST and NBLAST) can be used. See ncbi.nlm.nih.gov/BLAST/on the WorldWideWeb.

Another non-limiting example of a mathematical algorithm utilized for the comparison of sequences is the algorithm of Myers and Miller, CABIOS 1988; 4: 1 1-17. Such an algorithm is incorporated into the ALIGN program (version 2.0), which is part of the GCG sequence alignment software package. When utilizing the ALIGN program for comparing amino acid sequences, a PAM120 weight residue table, a gap length penalty of 12, and a gap penalty of 4 can be used.

In a preferred embodiment, the percent identity between two amino acid sequences is determined using the algorithm of Needleman and Wunsch (J. Mol. Biol. 1970, 48:444-453), which has been incorporated into the GAP program in the GCG software package (Accelrys, Burlington, MA; available at accelrys.com on the WorldWideWeb), using either a Blossum 62 matrix or a PAM250 matrix, a gap weight of 16, 14, 12, 10, 8, 6, or 4, and a length weight of 1, 2, 3, 4, 5, or 6. In yet another preferred embodiment, the percent identity between two nucleotide sequences is determined using the GAP program in the GCG software package using a NWSgapdna.CMP matrix, a gap weight of 40, 50, 60, 70, or 80, and a length weight of 1, 2, 3, 4, 5, or 6. A particularly preferred set of parameters (and the one that can be used if the practitioner is uncertain about what parameters should be applied to determine if a molecule is a sequence identity or homology limitation of the invention) is using a Blossum 62 scoring matrix with a gap open penalty of 12, a gap extend penalty of 4, and a frameshift gap penalty of 5.

Another non-limiting example of how percent identity can be determined is by using software programs such as those described in Current Protocols In Molecular Biology (F. M. Ausubel et al., eds., 1987) Supplement 30, section 7.7.18, Table 7.7.1. Preferably, default parameters are used for alignment. A preferred alignment program is BLAST, using default parameters. In particular, preferred programs are BLASTN and BLASTP, using the following default parameters: Genetic code=standard; filter=none; strand=both; cut-off=60; expect=10; Matrix=BLOSUM62; Descriptions=50 sequences; sort by=HIGH SCORE; Databases=non-redundant, GenBank+EMBL+DDBJ+PDB+GenBank CDS translations+SwissProtein+SPupdate+PIR. Details of these programs can be found at the following Internet address: http://www.ncbi.nlm.nih.gov/cgi-bin/BLAST.

Statistical analysis of the properties described herein may be carried out by standard tests, for example, t-tests, ANOVA, or Chi squared tests. Typically, statistical significance will be measured to a level of p=0.05 (5%), more preferably p=0.01, p=0.001, p=0.0001, p=0.000001

"Conservatively modified variants" of domain sequences also can be provided. With respect to particular nucleic acid sequences, conservatively modified variants refer to those nucleic acids which encode identical or essentially identical amino acid sequences, or where the nucleic acid does not encode an amino acid sequence, to essentially identical sequences. Specifically, degenerate codon substitutions can be achieved by generating sequences in which the third position of one or more selected (or all) codons is substituted with mixed-base and/or deoxyinosine residues (Batzer, et al., 1991, Nucleic Acid Res. 19: 5081; Ohtsuka, et al., 1985, J. Biol. Chem. 260: 2605-2608; Rossolini et al., 1994, Mol. Cell. Probes 8: 91-98).

The term "biologically active fragment", "biologically active form", "biologically active equivalent" of and "functional derivative" of a wild-type protein, possesses a biological activity that is at least substantially equal (e.g., not significantly different from) the biological activity of the wild type protein as measured using an assay suitable for detecting the activity.

As used herein, "in vivo" nucleic acid delivery, nucleic acid transfer, nucleic acid therapy" and the like, refer to the introduction of an improved LAMP Construct directly into the body of an organism, such as a human or non-human mammal, whereby the improved LAMP Construct is introduced to a cell of such organism in vivo.

As used herein, the term "in situ" refers to a type of in vivo nucleic acid delivery in which the improved LAMP Construct is brought into proximity with a target cell (e.g., the nucleic acid is not administered systemically). For example, in situ delivery methods include, but are not limited to, injecting an improved LAMP Construct directly at a site (e.g., into a tissue, such as a tumor or heart muscle), contacting the improved LAMP Construct with cell(s) or tissue through an open surgical field, or delivering the improved LAMP Constructs to a site using a medical access device such as a catheter.

As used herein, the term "isolated" or "purified" means separated (or substantially free) from constituents, cellular and otherwise, in which the polynucleotide, peptide, polypeptide, protein, antibody, or fragments thereof, are normally associated with in nature. For example, with respect to an improved LAMP Construct, an isolated polynucleotide is one that is separated from the 5' and 3' sequences with which it is normally associated in the chromosome. As is apparent to those of skill in the art, a non-naturally occurring polynucleotide, peptide, polypeptide, protein, antibody, or fragments thereof, does not require "isolation" to distinguish it from its naturally occurring counterpart. By substantially free or substantially purified, it is meant at least 50% of the population, preferably at least 70%, more preferably at least 80%, and even more preferably at least 90%, are free of the components with which they are associated in nature.

As used herein, a "target cell" or "recipient cell" refers to an individual cell or cell which is desired to be, or has been, a recipient of the improved LAMP Constructs described herein. The term is also intended to include progeny of a single cell, and the progeny may not necessarily be completely identical (in morphology or in genomic or total DNA complement) to the original parent cell due to natural, accidental, or deliberate mutation. A target cell may be in contact with other cells (e.g., as in a tissue) or may be found circulating within the body of an organism.

As used herein, a "subject" is a vertebrate, preferably a mammal, more preferably a human. Mammals include, but are not limited to, murines, simians, humans, farm animals, sport animals, and pets. In other preferred embodiments, the "subject" is a rodent (e.g. a rat, a mouse, a rabbit, a llama, camels, a cow, a guinea pig, a hamster, a dog, a cat, a horse, a non-human primate, a simian (e.g. a monkey or ape), a monkey (e.g. marmoset, baboon, rhesus macaque), or an ape (e.g. gorilla, chimpanzee, orangutan, gibbon). In other embodiments, non-human mammals, especially mammals that are conventionally used as models for demonstrating therapeutic efficacy in humans (e.g. murine, primate, porcine, canine, or rabbit animals) may be employed.

As used herein, the term "pharmaceutically acceptable carrier" encompasses any of the standard pharmaceutical carriers, such as a phosphate buffered saline solution, water, and emulsions, such as an oil/water or water/oil emulsion, and various types of wetting agents. Compositions comprising the improved LAMP Constructs also can include stabilizers and preservatives. For examples of carriers, stabilizers and adjuvants, see Martin Remington's Pharm. Sci., 15th Ed. (Mack Publ. Co., Easton (1975)).

A cell has been "transformed", "transduced", or "transfected" by the improved LAMP Constructs when such nucleic acids have been introduced inside the cell. Transforming DNA may or may not be integrated (covalently linked) with chromosomal DNA making up the genome of the cell. In prokaryotes, yeast, and mammalian cells for example, the improved LAMP Constructs may be maintained on an episomal element, such as a plasmid. In a eukaryotic cell, a stably transformed cell is one in which the improved LAMP Constructs have become integrated into a chromosome so that it is inherited by daughter cells through chromosome replication. This stability is demonstrated by the ability of the eukaryotic cell to establish cell lines or clones comprised of a population of daughter cells containing the improved LAMP Constructs. A "clone" is a population of cells derived from a single cell or common ancestor by mitosis. A "cell line" is a clone of a primary cell that is capable of stable growth in vitro for many generations (e.g., at least about 10).

As used herein, an "effective amount" is an amount sufficient to affect beneficial or desired results, e.g., such as an effective amount of the improved LAMP Construct transfer and/or expression, and/or the attainment of a desired therapeutic endpoint. An effective amount can be administered in one or more administrations, applications or dosages. In one aspect, an effective amount of an improved LAMP Construct is an amount sufficient to transform/transduce/transfect at least one cell in a population of cells comprising at least two cells.

As used herein, a "therapeutically effective amount" is used herein to mean an amount sufficient to prevent, correct and/or normalize an abnormal physiological response. In one aspect, a "therapeutically effective amount" is an amount sufficient to reduce by at least about 30 percent, more preferably by at least 50 percent, most preferably by at least 90 percent, a clinically significant feature of pathology, such as for example, size of a tumor mass, antibody production, cytokine production, fever or white cell count, etc.

An "antibody" is any immunoglobulin, including antibodies and fragments thereof, that binds a specific antigen. The term encompasses polyclonal, monoclonal, and chimeric antibodies (e.g., bispecific antibodies). An "antibody combining site" is that structural portion of an antibody molecule comprised of heavy and light chain variable and hypervariable regions that specifically binds antigen. Exemplary antibody molecules are intact immunoglobulin molecules, substantially intact immunoglobulin molecules, and those portions of an immunoglobulin molecule that contains the paratope, including Fab, Fab', F(ab')$_2$ and F(v) portions, which portions are preferred for use in the therapeutic methods described herein. Thus, the term antibody encompasses not only whole antibody molecules, but also antibody fragments as well as variants (including derivatives such as fusion proteins) of antibodies and antibody fragments. Examples of molecules which are described by the term "antibody" in this application include, but are not limited to: single chain Fvs (scFvs), Fab fragments, Fab' fragments, F(ab')$_2$, disulfide linked Fvs (sdFvs), Fvs, and fragments comprising or alternatively consisting of, either a VL or a VH domain. The term "single chain Fv" or "scFv" as used herein refers to a polypeptide comprising a VL domain of an antibody linked to a VH domain of an antibody. See Carter (2006) Nature Rev. Immunol. 6:243.

Additionally, antibodies of the invention include, but are not limited to, monoclonal, multi-specific, bi-specific, human, humanized, mouse, or chimeric antibodies, single chain antibodies, camelid antibodies, Fab fragments, F(ab') fragments, anti-idiotypic (anti-Id) antibodies (including, e.g., anti-Id antibodies to antibodies of the invention), domain antibodies and epitope-binding fragments of any of the above. The immunoglobulin molecules of the invention can be of any type (e.g., IgG, IgE, IgM, IgD, IgA and IgY), class (e.g., IgG1, IgG2, IgG3, IgG4, IgA1 and IgA2) or subclass of immunoglobulin molecule.

Most preferably, the antibodies are human antibodies. As used herein, "human" antibodies include antibodies having the amino acid sequence of a human immunoglobulin and include antibodies isolated from human immunoglobulin libraries and xenomice or other organisms that have been genetically engineered to produce human antibodies. The improved LAMP Constructs described herein can be used in combination with known techniques for generating human antibodies and human monoclonal antibodies as described in the exemplified protocols, see, e.g., PCT publications WO 98/24893; WO 92/01047; WO 96/34096; WO 96/33735; European Patent No. 0598877; U.S. Pat. Nos. 5,413,923; 5,625,126; 5,633,425; 5,569,825; 5,661,016; 5,545,806; 5,814,318; 5,885,793; 5,916,771; and 5,939,598; and Lonberg and Huszar, Int. Rev. Immunol. 13:65-93 (1995).

Human antibodies or "humanized" chimeric monoclonal antibodies can be produced using the improved LAMP Constructs in combination with techniques described herein or otherwise known in the art. For example, standard methods for producing chimeric antibodies are known in the art. See, for review the following references: Morrison, Science 229:1202 (1985); Oi et al., BioTechniques 4:214 (1986); Cabilly et al., U.S. Pat. No. 4,816,567; Taniguchi et al., EP 171496; Morrison et al., EP 173494; Neuberger et al., WO 8601533; Robinson et al., WO 8702671; Boulianne et al., Nature 312:643 (1984); Neuberger et al., Nature 314:268 (1985).

The antibodies of the present invention may be monovalent, bivalent, trivalent or multivalent. For example, monovalent scFvs can be multimerized either chemically or by association with another protein or substance. A scFv that is fused to a hexahistidine tag or a Flag tag can be multimerized using Ni-NTA agarose (Qiagen) or using anti-Flag antibodies (Stratagene, Inc.). Additionally, the improved LAMP Constructs can be used to generate monospecific, bispecific, trispecific or of greater multispecificity for the encoded allergen(s) contained in the improved LAMP Construct. See, e.g., PCT publications WO 93/17715; WO 92/08802; WO 91/00360; WO 92/05793; Tutt, et al., J. Immunol. 147:60-69 (1991); U.S. Pat. Nos. 4,474,893; 4,714,681; 4,925,648; 5,573,920; 5,601,819; Kostelny et. al., J. Immunol. 148:1547-1553 (1992).

An "epitope" is a structure, usually made up of a short peptide sequence or oligosaccharide, that is specifically recognized or specifically bound by a component of the immune system. T-cell epitopes have generally been shown to be linear oligopeptides. Two epitopes correspond to each other if they can be specifically bound by the same antibody. Two epitopes correspond to each other if both are capable of binding to the same B cell receptor or to the same T cell receptor, and binding of one antibody to its epitope substantially prevents binding by the other epitope (e.g., less than about 30%, preferably, less than about 20%, and more preferably, less than about 10%, 5%, 1%, or about 0.1% of the other epitope binds). In the present invention, multiple epitopes can make up an Allergen X (SEQ ID NO:Y).

The term "allergen" or "allergen of interest" as used herein covers any polypeptide sequence encoded by a polynucleotide sequence cloned into the improved LAMP Construct which is used to elicit an innate or adaptive immune response as shown in Table 1/FIG. 14. An "allergen" encompasses both a single allergen as well as multiple allergen sequences (derived from the same or different proteins) cloned into the improved LAMP Construct.

The term "antigen presenting cell" as used herein includes any cell which presents on its surface an allergen in association with a major histocompatibility complex molecule, or portion thereof, or, alternatively, one or more non-classical MHC molecules, or a portion thereof. Examples of suitable APCs are discussed in detail below and include, but are not limited to, whole cells such as macrophages, dendritic cells, B cells, hybrid APCs, and foster antigen presenting cells.

As used herein an "engineered antigen-presenting cell" refers to an antigen-presenting cell that has a non-natural molecular moiety on its surface. For example, such a cell may not naturally have a costimulator on its surface or may have an additional artificial costimulator in addition to a natural costimulator on its surface, or may express a non-natural class II molecule on its surface. In preferred embodiments, the engineered antigen-presenting cell has the allergen expressed from the improved LAMP Construct on its surface.

As used herein, "immune effector cells" refers to cells capable of binding an allergen and which mediate an immune response. These cells include, but are not limited to, T cells, B cells, monocytes, macrophages, NK cells and cytotoxic T lymphocytes (CTLs), for example CTL lines, CTL clones, and CTLs from tumor, inflammatory, or other infiltrates.

A "vector" includes plasmids and viruses and any DNA or RNA molecule, whether self-replicating or not, which can be used to transform or transfect a cell.

An "isolated" or "purified" population of cells is substantially free of cells and materials with which it is associated in nature. By substantially free or substantially purified APCs it is meant at least 50% of the population are APCs, preferably at least 70%, more preferably at least 80%, and even more preferably at least 90%, are free of non-APCs cells with which they are associated in nature.

As used herein, a "genetic modification" refers to any addition, deletion or disruption to a cell's normal nucleotides. Any method which can achieve the genetic modification of APCs are within the spirit and scope of this invention. Art recognized methods include viral mediated gene transfer, liposome mediated transfer, transformation, transfection and transduction, e.g., viral-mediated gene transfer such as the use of the improved LAMP Constructs based on DNA viruses such as adenovirus, adeno-associated virus and herpes virus, as well as retroviral based vectors.

The practice of the present invention employs, unless otherwise indicated, conventional molecular biology, microbiology, and recombinant DNA techniques within the skill of the art. Such techniques are explained fully in the literature. See, e.g., Maniatis, Fritsch & Sambrook, In Molecular Cloning: A Laboratory Manual (1982); DNA Cloning: A Practical Approach, Volumes I and II (D. N. Glover, ed., 1985); Oligonucleotide Synthesis (M. J. Gait, ed., 1984); Nucleic Acid Hybridization (B. D. Hames & S. J. Higgins, eds., 1985); Transcription and Translation (B. D. Hames & S. I. Higgins, eds., 1984); Animal Cell Culture (R. I. Freshney, ed., 1986); Immobilized Cells and Enzymes (IRL Press, 1986); B. Perbal, A Practical Guide to Molecular Cloning (1984).

Figure 2B:
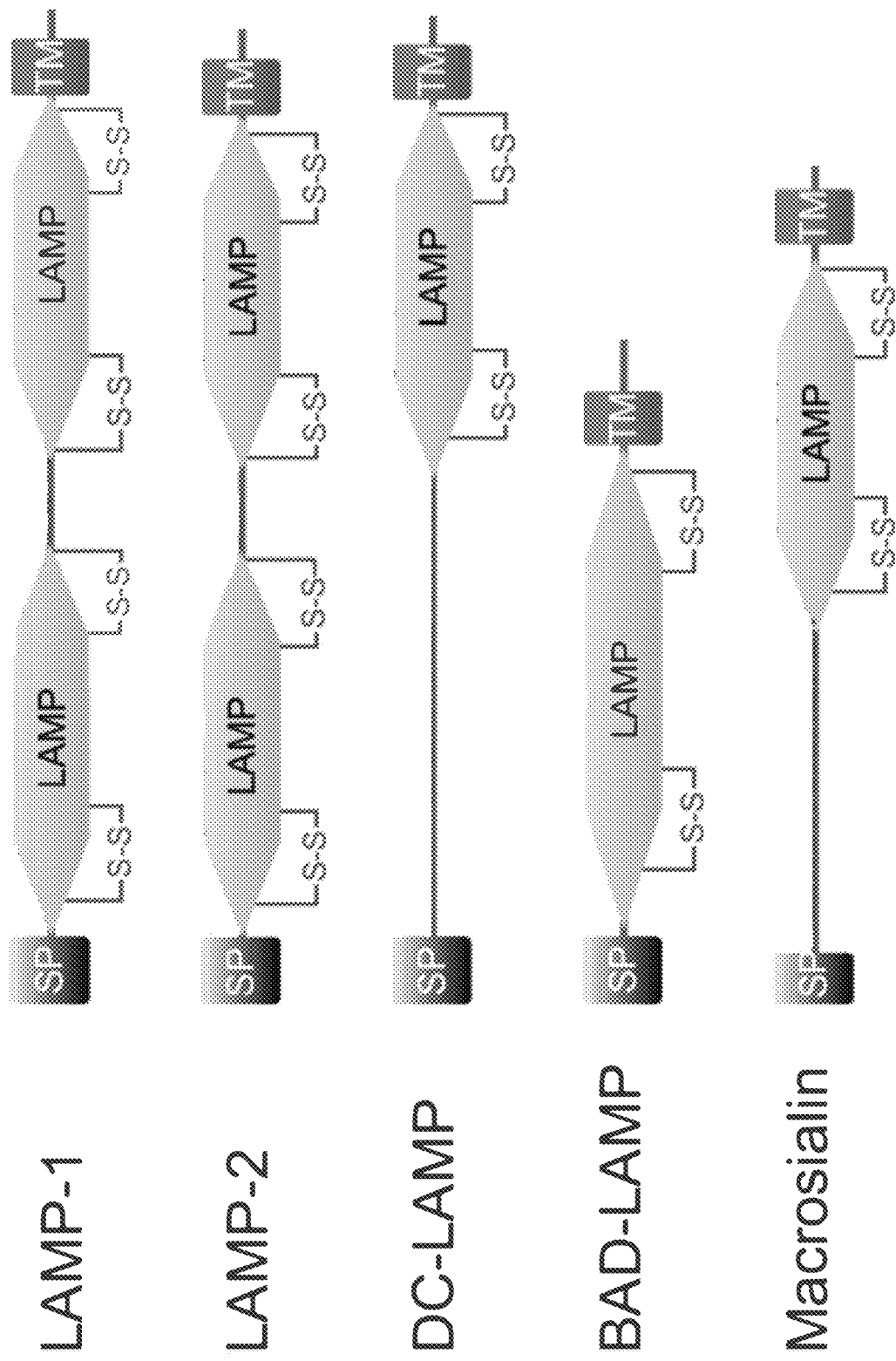

Unless defined otherwise, all technical and scientific terms used herein have the same meaning as commonly understood by one of ordinary skill in the art to which this invention belongs. All publications mentioned herein are incorporated by reference for the purpose of describing and disclosing devices, formulations and methodologies that may be used in connection with the presently described invention LAMP Constructs LAMP-1, as deduced from a cDNA clone (Chen, et al., J. Biol. Chem. 263: 8754, 1988) consists of a polypeptide core of about 382 amino acids with a large (346-residue) lumenal amino-terminal domain followed by a 24-residue hydrophobic transmembrane region and short (12-residue) carboxyl-terminal cytoplasmic tail. See, FIGS. 2A and 2B. The lumenal domain is highly glycosylated, being substituted with about 20 asparagine linked complex-type oligosaccharides and consists of two approximately 160-residue "homology domains" that are separated by a proline/serine-rich hinge region. Each of these "homology domains" contains 4 uniformly spaced cysteine residues, disulfide bonded to form four 36-38-residue loops symmetrically placed within the two halves of the lumenal domain (Arterburn, et al., J. Biol. Chem. 265: 7419, 1990; see, also Chen, et al., J. Biol. Chem. 25: 263(18): 8754-8, 1988). FIG. 2A schematically shows the conserved domains between LAMP-1, LAMP-2, LAMP-3, Endolyn, LIMBIC, LAMP5, or Macrosailin.

Previously reported LAMP constructs comprise the following elements in this specific arrangement: (a) a full lumenal domain of LAMP-1 protein, the antigen and then the full transmembrane/cytoplasmic tail of LAMP-1 protein; or (b) the antigen and the full transmembrane/cytoplasmic tail of a LAMP-1 protein. In example (a), the antigenic sequence is inserted in between the full lumenal domain of a LAMP-1 protein and the LAMP-1 full transmembrane domain/cytoplasmic tail. Both constructs have been shown to successfully target an antigenic sequence to the lysosome/endosome and will be referred to as "complete LAMP Constructs" as shown in FIG. 1 as compared to the improved LAMP Constructs ILC1-ILC6 described herein. The improved LAMP Constructs described herein do not include the complete LAMP Constructs described in the prior art.

Although it has been widely reported in the literature that fragments smaller than the full lumenal domain of LAMP-1 were not effective in generating a robust immune response (see, e.g. Godinho et al.). In contrast, the inventors unexpectedly discovered that specific fragments, in certain arrangements, did in fact effectively present allergens to the immune system, generating in many cases a more robust immune response, including the generation of a different repertoire of antibodies. For example, the inventors have identified that the minimal LAMP lumenal domain fragment that is effective for generating a robust immune response is not the full lumenal domain (as widely reported in the literature) but rather a single Homology Domain of the Lumenal Domain of a LAMP Protein.

For example, constructs can comprise, not the full lumenal domain, but instead a single Homology Domain of the Lumenal Domain of a LAMP Protein. As used herein, the "Homology Domain" comprises at least the 4 uniformly spaced cysteine residues shown in FIGS. 3-10. These cysteine resides are labeled 1, 2, 3, and 4 (and in LIMP-2 and Macrosailin—five cysteines are identified, LIMBIC—six cysteines are identified and Endolyn—eight cysteines are identified) in each Homology Domain as shown in FIGS. 3-10 and are defined herein as the "Cysteine Conserved Fragment." Additional amino acids can be included to either the N-terminus end and/or the C-terminus end of the Cysteine Conserved Fragment to generate, up to and including a full Homology Domain of a LAMP protein. These additional added amino acids can be derived from the Homology Domain from which the Cysteine Conserved Fragment is derived or from other LAMP Protein Homology Domains. Thus, as used herein, a LAMP Homology Domain comprises and/or consists of one Cysteine Conserved Fragment. At least two LAMP Homology Domains make up the Lumenal Domain of LAMP-1, LAMP-2, LAMP-3, or Endolyn.

Specifically, in one preferred embodiment, the improved LAMP Construct comprises at least one allergen described in Table 1/FIG. 14 and/or the combinations described in paragraph [0136-0137] and Table 2 fused to the N-terminus of the lumenal domain of a LAMP protein, at least one homology domain of a LAMP protein, or at least one Cysteine Conserved Fragment of a LAMP protein. See, for example ILC-2 and ILC-6 of FIG. 1. In preferred embodiments, these constructs also comprise a transmembrane domain of a LAMP protein, and/or the cytoplasmic tail of a LAMP protein. In other preferred embodiments, when an Allergen X (SEQ ID NO.Y) contains a transmembrane domain, the transmembrane domain of a LAMP protein and/or the cytoplasmic tail of a LAMP protein is unnecessary. In preferred embodiments, two homology domains are included in the improved LAMP Construct (e.g., ILC-1 of FIG. 1). In further preferred embodiments, the two homology domains are derived from a LAMP-1, LAMP-2, LAMP-3, or an Endolyn protein. Alternatively, the two homology domains are derived from different LAMP proteins. In these constructs comprising two homology domains, a LAMP hinge domain may also be included. The improved LAMP Constructs described in this paragraph are unexpected in view of the prior art as the antigen has always been placed in between the full lumenal LAMP-1 domain and the full LAMP-1 transmembrane/cytoplasmic tail, as fragments of the lumenal domain have not been reported to be effective in generating a robust immune response.

In another preferred embodiment, the improved LAMP Construct comprises at least one allergen described in Table 1/FIG. 14 and/or the combinations described in paragraph [0136-0137] and Table 2 fused to the C-terminus of a single homology domain of a LAMP protein or a single Cysteine Conserved Fragment of a LAMP protein (e.g., ILC-5 of FIG. 1). In preferred embodiments, these constructs also comprise a transmembrane domain of a LAMP protein, and/or the cytoplasmic tail of a LAMP protein (e.g., ILC-3 of FIG. 1) In other preferred embodiments, when an Allergen X (SEQ ID NO:Y) contains a transmembrane domain, the transmembrane domain of a LAMP protein and/or the cytoplasmic tail of a LAMP protein is unnecessary. Alternatively, two homology domains from two different LAMP proteins may be used. The improved LAMP Constructs described in this paragraph are unexpected in view of the prior art as the allergen has always been placed in between the full lumenal LAMP-1 domain and the full LAMP-1 transmembrane/cytoplasmic tail, as fragments of the lumenal domain have not been reported to be effective in generating a robust immune response.

Thus, the improved LAMP Construct comprises at least one allergen described in Table 1/FIG. 14 and/or the combinations described in paragraph [0136-0137] and Table 2 fused to the C-terminus of a single homology domain of a LAMP protein or a single Cysteine Conserved Fragment of a LAMP protein. See, for example, ILC-3 and ILC-5 of FIG. 1. In preferred embodiments, these constructs also comprise a transmembrane domain of a LAMP protein, and/or the cytoplasmic tail of a LAMP protein. In other preferred embodiments, when an Allergen X (SEQ ID NO.Y) contains a transmembrane domain, the transmembrane domain of a LAMP protein and/or the cytoplasmic tail of a LAMP protein is unnecessary. The improved LAMP Constructs described in this paragraph are unexpected in view of the prior art as described above.

In another preferred embodiment, the improved LAMP Construct comprises at least one allergen of interest fused in between a first homology domain of a LAMP protein and a second homology domain of a LAMP protein (or at least between two Cysteine Conserved Fragments). See, for example, ILC-4 of FIG. 1. In preferred embodiments, the two homology domains are derived from LAMP-1, LAMP-2, LAMP-3, or an Endolyn protein. In these constructs, the allergen may be placed in the LAMP hinge region. Alternatively, two homology domains from two different LAMP proteins may be used. This arrangement of at least one allergen described in Table 1/FIG. 14 and/or the combinations described in paragraph [0136-0137] and Table 2 fused in between two LAMP homology domains (including Cysteine Conserved Fragments) is unexpected in view of the prior art as described above.

Each of the improved LAMP Constructs defined above can be generated using the domains defined in the Figures. For example, it is specifically contemplated that the domains included in the improved LAMP Construct illustrated in FIG. 1, for example, can originate from sequences derived from orthologous sequences. See, FIGS. 3-10 for example. It is expressly contemplated that the equivalent domains defined in FIGS. 2A and 2B be used to generate the improved LAMP Constructs illustrated in FIG. 1 for orthologous sequences. Moreover, the orthologous sequences shown in FIGS. 3-10 are representative of the sequences that can be used to generate the domains. It is well within the skill in the art to identify other orthologous sequences and/or isotypes and comparing them to the alignments shown in FIGS. 3-10. Thus, by identifying the equivalent boundaries defined in FIGS. 2A and 2B for a human LAMP protein with the alignments shown in FIGS. 3-10, one can generate the improved LAMP Constructs illustrated in FIG. 1.

As would be well understood by the skilled artisan, the boundaries of each domain are an approximation and may be adjusted at least 1, 2, 3, 4, 5, 6, 7, 8, 9, or 10 amino acids based on cloning considerations and restriction enzyme placement. Therefore, when a particular domain (e.g., a LAMP Homology Domain) is included in the improved LAMP Construct, the amino acids beginning and ending of the domain may be adjust by at least 1, 2, 3, 4, 5, 6, 7, 8, 9, or 10 amino acids as those boundaries defined in FIG. 2A.

Each of the improved LAMP Constructs described above can additionally comprise a signal sequence and/or additional amino acids in between each domain for cloning purposes as is well known in the art. Additionally, the LAMP homologous domains, the LAMP lumenal domain, the LAMP transmembrane domain, and/or the LAMP cytoplasmic tail domain can originate from the same LAMP protein (e.g., human LAMP-1) or different LAMP proteins (e.g., lumenal domain from human LAMP-1 and transmembrane domain from human LAMP-2, and/or mixing of orthologous domains in the same gene family (e.g., LAMP-1) or different gene family (LAMP-1 and LAMP-2).

Polypeptide variants of the described LAMP Constructs are contemplated. For example, polypeptides at least about 60%, at least about 70%, at least about 75%, at least about 80%, at least about 85%, at least about 90%, at least about 95%, 96%, 97%, 98% or 99% identity to any of the improved LAMP Constructs described herein as well as polynucleotides encoding these variants. Variants of the improved LAMP Constructs retain the ability to function by targeting the allergenic sequence to the lysosome. For example, a modified lumenal sequence must retain the ability to traffic both membrane and non-membrane antigenic materials to an endosomal compartment with at least about 50%, at least about 60%, at least 70%, at least about 80%, at least about 90%, or at least about 100% efficacy compared to the original domain sequence, i.e., an efficacy that results in sufficient antigen presentation by a cell comprising the chimeric sequence for it to mount an immune response. In one aspect, sequences containing a suitable trafficking signal may be identified by constructing an improved LAMP Construct containing the well-characterized antigenic domain of ovalbumin, a transmembrane domain, and the cytoplasmic domain of a protein containing a putative lysosomal/endosomal targeting signal. Efficiency of targeting can be measured by determining the ability of antigen presenting cells, expressing the improved LAMP Construct, to stimulate HA epitope-specific, MHC class II restricted T-cells (see, e.g., Example 5 of U.S. Pat. No. 5,633,234).

Polynucleotides encoding any of the described improved LAMP Constructs are preferred embodiments of the invention, along with polynucleotides at least about 60%, at least about 70%, at least about 75%, at least about 80%, at least about 85%, at least about 90%, at least about 95%, 96%, 97%, 98% or 99% identity to any of the improved LAMP Construct polynucleotides described herein. Variants of the improved LAMP Constructs retain the ability to function by targeting the allergenic sequence to the lysosome. For example, a modified lumenal sequence must retain the ability to traffic both membrane and non-membrane antigenic materials to an endosomal compartment with at least about 50%, at least about 60%, at least 70%, at least about 80%, at least about 90%, or at least about 100% efficacy compared to the original domain sequence, i.e., an efficacy that results in sufficient antigen presentation by a cell comprising the chimeric sequence for it to mount an immune response. In one aspect, sequences containing a suitable trafficking signal may be identified by constructing an improved LAMP Construct containing the well-characterized antigenic domain of ovalbumin, a transmembrane domain, and the cytoplasmic domain of a protein containing a putative lysosomal/endosomal targeting signal. Efficiency of targeting can be measured by determining the ability of antigen presenting cells, expressing the improved LAMP Construct, to stimulate HA epitope-specific, MHC class II restricted T-cells (see, e.g., Example 5 of U.S. Pat. No. 5,633,234).

Allergens

The following allergens shown in Table 1/FIG. 14 (e.g., Allergen X) can be cloned into each of the LAMP Constructs described herein using techniques well known to the skilled artisan. Moreover, it is specifically contemplated that any one of the Allergen X (SEQ ID NO:Y) listed in Table 1/FIG. 14 can be combined with any other antigen listed in Table 1/FIG. 14 and inserted into the improved LAMP Constructs as described herein, and specifically as disclosed in Table 2.

As used herein, the term "Allergen X" refers to the specific genes/proteins listed in the following Table 1/FIG. 14, fragments thereof (such as fragments of SEQ ID NO:Y (e.g., as described in column 4 of Table 1) wherein the signal sequence is removed (e.g., as described in column 3 of Table 1)), or mixtures of the listed proteins that are known to induce allergies, i.e., IgE mediated reactions upon their repeated exposure to an individual. Generally, an allergen is any compound, substance, or material that is capable of evoking an allergic reaction. Allergens are usually understood as a subcategory of antigens, which are compounds, substances, or materials capable of evoking an immune response. For carrying out the invention, Allergen X may be selected, among other things, from natural or native allergens, modified natural allergens, synthetic allergens, recombinant allergens, allergoids, and mixtures or combinations thereof. Of particular interest is Allergen X that is capable of causing an IgE-mediated immediate type hypersensitivity.

As used herein, the amino acid sequence of Allergen X comprises any one of SEQ ID NO:Y (with or without the signal sequence). Representative examples of polynucleotides that can encode Allergen X (SEQ ID NO:Y) are shown as SEQ ID NO:Z in Table 1/FIG. 14 or any polynucleotide (such as a codon optimized sequence) that encodes the Allergen X as described in column 2 or the fragments described in column 4 of Table 1. These polynucleotides are inserted into any one of the Constructs ILC1-6 as shown in FIG. 1 (with or without the signal sequence of SEQ ID NO:Y). Insertion may be facilitated by the use of cloning sequences that flank the amino acid sequence of SEQ ID NO:Y, such as, for example, polynucleotides that encode "Leu-Glu" and "Glu-Phe" (e.g., "CTCGAG" and "GAATTC.") As used herein, "Allergen X" also encompasses variants (including fragments) of Allergen X. For example, preferred embodiments include Allergen X polypeptide variants that have at least about 60%, at least about 70%, at least about 75%, at least about 80%, at least about 85%, at least about 90%, at least about 95%, 96%, 97%, 98% or 99% identity to SEQ ID NO: Y (as described in column 2 or column 4 of Table 1). These variants retain either (a) the ability to raise an antibody that cross-reacts with the Allergen X from which it was derived and/or (b) Allergen X biological activity. Polynucleotides that encode these variant Allergen X polypeptides are specifically contemplated.

The invention further provides a nucleic acid molecule encoding any of the Allergen X of Table 1/FIG. 14. The invention also provides a vector comprising the nucleic acid encoding Allergen X (SEQ ID NO:Y), such as, for example, SEQ ID NO:Z or any polynucleotide (such as a codon optimized sequence) that encodes the Allergen X as described in column 2 or the fragments described in column 4 of Table 1, wherein the nucleic acid molecule is operably linked to an expression control sequence in any one of ILC1-6. In one preferred aspect, the vector is a vaccine vector, suitable for vaccinating a patient against Allergen X. In another aspect, the invention provides a delivery vehicle comprising the nucleic acid molecule for facilitating the introduction of the nucleic acid molecule into a cell. The delivery vehicle may be lipid-based (e.g., a liposome formulation), viral-based (e.g., comprising viral proteins encapsulating the nucleic acid molecule), or cell-based. In one preferred aspect, the vector is a vaccine vector. As would be well understood by the skilled artisan, columns 1 and 4 of Table 1 defines the preferred amino acids to be cloned into the improved LAMP Constructs described herein. However, both the N-terminal and the C-terminal boundaries of the fragments described in columns 1 and 4 of Table 1 are an approximation and may be adjusted at least by 1, 2, 3, 4, 5, 6, 7, 8, 9, or 10 amino acids based on cloning considerations and restriction enzyme placement. Therefore, when Allergen X is included in the improved LAMP Construct, the amino acids beginning and ending of Allergen X may be adjust by at least 1, 2, 3, 4, 5, 6, 7, 8, 9, or 10 amino acids as defined in columns 1 and 4 of Table 1.

| Allergen X | Amino Acid Sequence of Allergen X (SEQ ID NO: Y) | Amino Acids of SEQ ID NO: Y relating to Signal Sequence | Preferred Amino Acids of SEQ ID NO: Y to be included in improved LAMP Constructs | Representative Polynucleotide Sequences Encoding SEQ ID NO: Y (SEQ ID NO: Z) |
|---|---|---|---|---|
| Cor a 1 | SEQ ID NO: 115 | | SEQ ID NO: 115 | SEQ ID NO: 114 |
| Cor a 9 | SEQ ID NO: 117 | | SEQ ID NO: 117 | SEQ ID NO: 116 |
| Cor a 1 - Gly4 - Cor a 9 | SEQ ID NO: 119 | | SEQ ID NO: 119 | SEQ ID NO: 118 |
| Pru du 6 | SEQ ID NO: 121 | | SEQ ID NO: 121 | SEQ ID NO: 120 |
| Ana o 1 | SEQ ID NO: 123 | | SEQ ID NO: 123 | SEQ ID NO: 122 |
| Ana o 2 | SEQ ID NO: 125 | | SEQ ID NO: 125 | SEQ ID NO: 124 |
| Ana o 3 | SEQ ID NO: 127 | | SEQ ID NO: 127 | SEQ ID NO: 126 |

-continued

| Allergen X | Amino Acid Sequence of Allergen X (SEQ ID NO: Y) | Amino Acids of SEQ ID NO: Y relating to Signal Sequence | Preferred Amino Acids of SEQ ID NO: Y to be included in improved LAMP Constructs | Representative Polynucleotide Sequences Encoding SEQ ID NO: Y (SEQ ID NO: Z) |
|---|---|---|---|---|
| Ana o 2 - Gly4 - Ana o 1 - Gly4 - Ana o 3 | SEQ ID NO: 129 | | SEQ ID NO: 129 | SEQ ID NO: 128 |
| Jug n 1 | SEQ ID NO: 131 | | SEQ ID NO: 131 | SEQ ID NO: 130 |
| Jug r 2 | SEQ ID NO: 133 | | SEQ ID NO: 133 | SEQ ID NO: 132 |
| Jug n 1 - Gly4 - Jug r 2 | SEQ ID NO: 135 | | SEQ ID NO: 135 | SEQ ID NO: 134 |
| Amb a 1 | SEQ ID NO: 137 | | SEQ ID NO: 137 | |
| Bet v 1-A | SEQ ID NO: 141 | | SEQ ID NO: 141 | |
| Can f 1 | SEQ ID NO: 145 | | SEQ ID NO: 145 | |
| Cyn d 1 | SEQ ID NO: 149 | | SEQ ID NO: 149 | |
| Der F 1 (19-321) | SEQ ID NO: 153 | | SEQ ID NO: 153 | |
| Der F 1 (99-321) | SEQ ID NO: 157 | | SEQ ID NO: 157 | |
| Der P2 | SEQ ID NO: 161 | | SEQ ID NO: 161 | |
| Der F 2 | SEQ ID NO: 165 | | SEQ ID NO: 165 | |
| DerP1 (del) | SEQ ID NO: 169 | | SEQ ID NO: 169 | |
| Fel D 1 | SEQ ID NO: 173 | | SEQ ID NO: 173 | |
|  | SEQ ID NO: 174 | | SEQ ID NO: 174 | |
| Fel d 2 | SEQ ID NO: 178 | | SEQ ID NO: 178 | |
| Fel d 4 | SEQ ID NO: 182 | | SEQ ID NO: 182 | |
| Lit v 1 | SEQ ID NO: 186 | | SEQ ID NO: 186 | |
| Lol p 5a | SEQ ID NO: 190 | | SEQ ID NO: 190 | |
| Phl p 1 | SEQ ID NO: 194 | | SEQ ID NO: 194 | |
| Phl p 5 | SEQ ID NO: 198 | | SEQ ID NO: 198 | |
| Der f 15 | SEQ ID NO: 201 | | SEQ ID NO: 201 | |
| Derf 18 | SEQ ID NO: 202 | | SEQ ID NO: 202 | |
| Zen-1 | SEQ ID NO: 203 | | SEQ ID NO: 203 | |
| Cte f 1 | SEQ ID NO: 204 | | SEQ ID NO: 204 | |
| Der F15-Der F18 | SEQ ID NO: 205 | | SEQ ID NO: 205 | |
| Der F1-Der F2 | SEQ ID NO: 206 | | SEQ ID NO: 206 | |
| Api m1 | SEQ ID NO: 207 | | SEQ ID NO: 207 | |
| Api m2 | SEQ ID NO: 208 | | SEQ ID NO: 208 | |
| Api m3 | SEQ ID NO: 209 | | SEQ ID NO: 209 | |
| Api m5 | SEQ ID NO: 210 | | SEQ ID NO: 210 | |
| Api m10 | SEQ ID NO: 211 | | SEQ ID NO: 211 | |
| Ves v1 | SEQ ID NO: 212 | | SEQ ID NO: 212 | |
| Ves v2 | SEQ ID NO: 213 | | SEQ ID NO: 213 | |
| Ves v3 | SEQ ID NO: 214 | | SEQ ID NO: 214 | |
| Ves v5 | SEQ ID NO: 215 | | SEQ ID NO: 215 | |

-continued

| Allergen X | Amino Acid Sequence of Allergen X (SEQ ID NO: Y) | Amino Acids of SEQ ID NO: Y relating to Signal Sequence | Preferred Amino Acids of SEQ ID NO: Y to be included in improved LAMP Constructs | Representative Polynucleotide Sequences Encoding SEQ ID NO: Y (SEQ ID NO: Z) |
|---|---|---|---|---|
| Pol d1 | SEQ ID NO: 216 | | SEQ ID NO: 216 | |
| Pol d5 | SEQ ID NO: 217 | | SEQ ID NO: 217 | |
| Ara H1 | SEQ ID NO: 218 | 1-25 | 26-626 | |
| Ara H2 | SEQ ID NO: 219 | | SEQ ID NO: 219 | |
| Ara H3 | SEQ ID NO: 220 | 1-20 | 21-512 | |
| AraH1-AraH2-AraH3 | SEQ ID NO: 221 | | SEQ ID NO: 221 | |
| Cry J1 (*C. japonica*) | SEQ ID NO: 222 | 1-21 | 22-374 | |
| Cry J2 (*C. japonica*) | SEQ ID NO: 223 | 1-22 | 23-514 | |
| CryJ1-Cry J2 (*C. japonica*) | SEQ ID NO: 224 | | SEQ ID NO: 224 | |
| Cry J3 (Cry 13.8; *C. japonica*) | SEQ ID NO: 225 | 1-26 | 27-225 | |
| CJP-4 (*C. japonica*) | SEQ ID NO: 226 | 1-34 | 35-281 | |
| CJP-6 (*C. japonica*) | SEQ ID NO: 227 | 1-35 | 36-306 | |
| CJP-8 (*C. japonica*) | SEQ ID NO: 228 | 1-35 | 36-165 | |
| CPA63 (*C. japonica*) | SEQ ID NO: 229 | 1-20 | 21-472 | |
| CJP38 (*C. japonica*) | SEQ ID NO: 230 | 1-28 | 29-348 | |
| Cha o 1 (*C. obtuse*) | SEQ ID NO: 231 | 1-21 | 22-375 | |
| Jun a 1 (*J. ashei*) | SEQ ID NO: 232 | 1-21 | 22-367 | |
| Jun v 1 (*J. virginiana*) | SEQ ID NO: 233 | 1-21 | 22-367 | |
| Cup a 1 (*H. arizonica*) | SEQ ID NO: 234 | 1-21 | 22-367 | |
| Jun o 1 (*J. oxycedrus*) | SEQ ID NO: 235 | 1-21 | 22-366 | |
| Cup s 1 (*C. sempervirens*) | SEQ ID NO: 236 | 1-21 | 22-367 | |
| Cha o 2 (*C. obtuse*) (signal sequence is residues 1-22) | SEQ ID NO: 237 | 1-50 | 51-514 | |
| Jun a 2 (*J. ashei*) (signal sequence is residues 1-22) | SEQ ID NO: 238 | 1-53 | 54-507 | |
| Cup a 2 (*H. arizonica*) | SEQ ID NO: 239 | | SEQ ID NO: 239 | |
| Jun a 3 (*J. ashei*) (signal sequence is residues 1-26) | SEQ ID NO: 240 | 1-26 | 27-225 | |
| Jun r 3 (*J. rigida*) | SEQ ID NO: 241 | 1-26 | 27-225 | |
| Cup s 3 (*C. sempervirens*) | SEQ ID NO: 242 | 1-26 | 27-224 | |
| Cup a 3 (*H. arizonica*) | SEQ ID NO: 243 | | SEQ ID NO: 243 | |
| Ch4A (*P. monticola*) | SEQ ID NO: 244 | 1-25 | 26-274 | |
| Ch4-1 (*P. menziesii*; SEQ ID NO: 30) | SEQ ID NO: 245 | 1-26 | 27-277 | |
| PT-1 (*P. taeda*) | SEQ ID NO: 246 | | SEQ ID NO: 246 | |
| LTP (*P. abies*) | SEQ ID NO: 247 | 1-25 | 26-173 | |
| Ara H 6 | SEQ ID NO: 248 | | SEQ ID NO: 248 | |

| Allergen X | Amino Acid Sequence of Allergen X (SEQ ID NO: Y) | Amino Acids of SEQ ID NO: Y relating to Signal Sequence | Preferred Amino Acids of SEQ ID NO: Y to be included in improved LAMP Constructs | Representative Polynucleotide Sequences Encoding SEQ ID NO: Y (SEQ ID NO: Z) |
|---|---|---|---|---|
| Ara H 8 | SEQ ID NO: 249 | | SEQ ID NO: 249 | |
| Ara H 9 | SEQ ID NO: 250 | | SEQ ID NO: 250 | |

Additionally, more than one Allergen X can be combined (in any order) and administered as a vaccine as in any one of the improved LAMP Constructs as described herein. It is specifically envisioned that the combinations of Allergen X can be cloned within a single improved LAMP construct, or can be delivered in a composition comprising multiple improved LAMP constructs of Allergen X. Specifically, Allergen X as described in Table 1/FIG. 14 can be cloned into the improved LAMP Constructs described herein either individually, or in combination with one another Allergen X as described in Table 2. The order of the combination of Allergen X as described in Table 2 for a particular improved LAMP construct can vary as this list describes what an improved LAMP Construct comprises and not necessarily to describe the arrangement of the Allergen X within a particular construct.

In preferred embodiments, the improved LAMP Constructs described herein comprise, or consist, (a) any one of the polynucleotides of SEQ ID NO:Z as shown in Table 1/FIG. 14; (b) a polynucleotide encoding a polypeptide encoded by any one of the polynucleotides of SEQ ID NO:Z as shown in Table 1/FIG. 14; (c) a polynucleotide that encodes a polypeptide comprising the amino acid sequence as described in either column 2 or column 4 of SEQ ID NO: Y as shown in Table 1/FIG. 14; or (g) polynucleotides with at least about 60%, at least about 70%, at least about 75%, at least about 80%, at least about 85%, at least about 90%, at least about 95%, 96%, 97%, 98% or 99% identity to any one of the polynucleotides of (a)-(c). Polypeptides encoded by these polynucleotides are additional preferred embodiments.

TABLE 2

| Allergen X | Can be combined with any one or more of the following Allergens: |
|---|---|
| Cor a 1 | Cor a 9, Pru du 6, Ana 0 1, Ana 0 2, Ana 0 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Cor a 9 | Cor a 1, Pru du 6, Ana 0 1, Ana 0 2, Ana 0 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Pru du 6 | Cor a 1, Cor a 9, Ana 0 1, Ana 0 2, Ana 0 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Ana o 1 | Cor a 1, Cor a 9, Pru du 6, Ana 0 2, Ana 0 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cups 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Ana o 2 | Cor a 1, Cor a 9, Pru du 6, Ana 0 1, Ana 0 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v |

TABLE 2-continued

| Allergen X | Can be combined with any one or more of the following Allergens: |
|---|---|
| | 1, Cup a 1, Jun o 1, Cups 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Ana o 3 | Cor a 1, Cor a 9, Pru du 6, Ana 0 1, Ana 0 2, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cups 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Jug n 1 | Cor a 1, Cor a 9, Pru du 6, Ana 0 1, Ana 0 2, Ana 0 3, Jug r 2, Amb a 1, Bet v 1-A, Canf 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, +10 Cry J3, CJP-4, CJP-6, CJP-8, CPA63, CJP38, Cha o 1, Jun a 1, Jun v 1, Cup a 1, Jun o 1, Cups 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Jug r 2 | Cor a 1, Cor a 9, Pru du 6, Ana 0 1, Ana 0 2, Ana 0 3, Jug n 1, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cups 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Amb a 1 | Cor a 1, Cor a 9, Pru du 6, Ana 0 1, Ana 0 2, Ana 0 3, Jug n 1, Jug r 2, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cups 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Bet v 1-A | Cor a 1, Cor a 9, Pru du 6, Ana 0 1, Ana 0 2, Ana 0 3, Jug n 1, Jug r 2, Amb a 1, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Can f1 | Cor a 1, Cor a 9, Pru du 6, Ana 0 1, Ana 0 2, Ana 0 3, Jug n 1, Jug r 2, Amb a 1, Bet v 1-A, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cups 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Cyn d 1 | Cor a 1, Cor a 9, Pru du 6, Ana 0 1, Ana 0 2, Ana 0 3, Jug n 1, Jug r 2, Amb a 1, Bet v 1-A, Can f 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cups 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Der F 1 (19-321) | Cor a 1, Cor a 9, Pru du 6, Ana 0 1, Ana 0 2, Ana 0 3, Jug n 1, Jug r 2, Amb a 1, Bet v 1-A, Can f 1, Cyn d 1, Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Der F 1 | Cor a 1, Cor a 9, Pru du 6, Ana 0 1, Ana 0 2, Ana 0 3, Jug n 1, Jug r 2, Amb a 1, Bet v 1-A, Can f 1, Cyn d 1, Der F 1 (19-321), Der P2, Der F 2, DerP1 |

TABLE 2-continued

| Allergen X | Can be combined with any one or more of the following Allergens: |
|---|---|
| (99-321) | (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Der P2 | Cor a 1, Cor a 9, Pru du 6, Ana 0 1, Ana 0 2, Ana 0 3, Jug n 1, Jug r 2, Amb a 1, Bet v 1-A, Can f 1, Cyn d 1, Der F 1 (19-321), Der F 1 (99-321), Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cups 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Der F 2 | Cor a 1, Cor a 9, Pru du 6, Ana 0 1, Ana 0 2, Ana 0 3, Jug n 1, Jug r 2, Amb a 1, Bet v 1-A, Canf 1, Cyn d 1, Der F 1 (19-321), Der F 1 (99-321), Der P2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| DerP1 (del) | Cor a 1, Cor a 9, Pru du 6, Ana 0 1, Ana 0 2, Ana 0 3, Jug n 1, Jug r 2, Amb a 1, Bet v 1-A, Canf 1, Cyn d 1, Der F 1 (19-321), Der F 1 (99-321), Der P2, Der F 2, Fel d 1, Fel d 2, Fel d 4, Lit v 1, Lol p 5a, Phl p 1, Phl p 5, Der f 15, Derf 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cups 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Fel D 1 | Cor a 1, Cor a 9, Pru du 6, Ana 0 1, Ana 0 2, Ana 0 3, Jug n 1, Jug r 2, Amb a 1, Bet v 1-A, Canf 1, Cyn d 1, Der F 1 (19-321), Der F 1 (99-321), Der P2, Der F 2, DerP1 (del), Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cups 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Fel d 2 | Cor a 1, Cor a 9, Pru du 6, Ana 0 1, Ana 0 2, Ana 0 3, Jug n 1, Jug r 2, Amb a 1, Bet v 1-A, Canf 1, Cyn d 1, Der F 1 (19-321), Der F 1 (99-321), Der P2, Der F 2, DerP1 (del), Fel d 1, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cups 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Fel d 4 | Cor a 1, Cor a 9, Pru du 6, Ana 0 1, Ana 0 2, Ana 0 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Lit v 1 | Cor a 1, Cor a 9, Pru du 6, Ana 0 1, Ana 0 2, Ana 0 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Lol p 5a | Cor a 1, Cor a 9, Pru du 6, Ana 0 1, Ana 0 2, Ana 0 3, Jug n 1, Jug r 2, Amb a 1, Bet v 1-A, Canf 1, Cyn d 1, Der F 1 (19-321), Der F 1 (99-321), Der P2, Der F 2, DerP1 (del), Fel d 1, Fel d 2, Fel d 4, Lit v 1, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, +10 Cry J3, CJP-4, CJP-6, CJP-8, CPA63, CJP38, Cha o 1, Jun a 1, Jun v |

TABLE 2-continued

| Allergen X | Can be combined with any one or more of the following Allergens: |
|---|---|
| | 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Phl p 1 | Cor a 1, Cor a 9, Pru du 6, Ana 0 1, Ana 0 2, Ana 0 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 5, Derf 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cups 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Phl p 5 | Cor a 1, Cor a 9, Pru du 6, Ana 0 1, Ana 0 2, Ana 0 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Derf 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cups 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Der f 15 | Cor a 1, Cor a 9, Pru du 6, Ana 0 1, Ana 0 2, Ana 0 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Derf 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Der f 18 | Cor a 1, Cor a 9, Pru du 6, Ana 0 1, Ana 0 2, Ana 0 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cups 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Zen-1 | Cor a 1, Cor a 9, Pru du 6, Ana 0 1, Ana 0 2, Ana 0 3, Jug n 1, Jug r 2, Amb a 1, Bet v 1-A, Canf 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cups 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Cte f 1 | Cor a 1, Cor a 9, Pru du 6, Ana 0 1, Ana 0 2, Ana 0 3, Jug n 1, Jug r 2, Amb a 1, Bet v 1-A, Can f 1, Cyn d 1, Der F 1 (19-321), Der F 1 (99-321), Der P2, Der F 2, DerP1 (del), Feld 1, Fel d 2, Fel d 4, Lit v 1, Lol p 5a, Phl p 1, Phl p 5, Der f 15, Derf 18, Zen-1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Api m1 | Cor a 1, Cor a 9, Pru du 6, Ana 0 1, Ana 0 2, Ana 0 3, Jug n 1, Jug r 2, Amb a 1, Bet v 1-A, Canf 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s+10 3, Cup a 3, Ch4A, Ch4-1, PT-1, LTP, Ara H 6, Ara H 8, and/or Ara H 9 |
| Api m2 | Cor a 1, Cor a 9, Pru du 6, Ana 0 1, Ana 0 2, Ana 0 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Api m3 | Cor a 1, Cor a 9, Pru du 6, Ana 0 1, Ana 0 2, Ana 0 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl |

TABLE 2-continued

| Allergen X | Can be combined with any one or more of the following Allergens: |
|---|---|
| | p 5, Der f 15, Der f 18, Zen-1, Cte f 1, Api m1, Api m2, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cups 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Api m5 | Cor a 1, Cor a 9, Pru du 6, Ana 0 1, Ana 0 2, Ana 0 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s+10 3, Cup a 3, Ch4A, Ch4-1, PT-1, LTP, Ara H 6, Ara H 8, and/or Ara H 9 |
| Api m10 | Cor a 1, Cor a 9, Pru du 6, Ana 0 1, Ana 0 2, Ana 0 3, Jug n 1, Jug r 2, Amb a 1,+10 Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cups 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Ves v1 | Cor a 1, Cor a 9, Pru du 6, Ana 0 1, Ana 0 2, Ana 0 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Ves v2 | Cor a 1, Cor a 9, Pru du 6, Ana 0 1, Ana 0 2, Ana 0 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Ves v3 | Cor a 1, Cor a 9, Pru du 6, Ana 0 1, Ana 0 2, Ana 0 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v5, Pol d1, Pol d5, Ara H1, Ara H2, Ara H3, Cry J1, Cry+10 J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Ves v5 | Cor a 1, Cor a 9, Pru du 6, Ana 0 1, Ana 0 2, Ana 0 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Pol d1 | Cor a 1, Cor a 9, Pru du 6, Ana 0 1, Ana 0 2, Ana 0 3, Jug n 1, Jug r 2, Amb a 1, Bet v 1-A, Canf 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Pol d5 | Cor a 1, Cor a 9, Pru du 6, Ana 0 1, Ana 0 2, Ana 0 3, Jug n 1, Jug r 2, Amb a 1, Bet v 1-A, Canf 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cups 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |

TABLE 2-continued

| Allergen X | Can be combined with any one or more of the following Allergens: |
|---|---|
| Ara H1 | Cor a 1, Cor a 9, Pru du 6, Ana o 1, Ana o 2, Ana o 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cups 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Ara H2 | Cor a 1, Cor a 9, Pru du 6, Ana o 1, Ana o 2, Ana o 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Ara H3 | Cor a 1, Cor a 9, Pru du 6, Ana o 1, Ana o 2, Ana o 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Cry J1, Cry J2, Cry J3, CJP-4, CJP-6, CJP-8, CPA63, CJP38, Cha o 1, Jun a 1, Jun v 1, Cup a 1, Jun o 1, Cups 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Cry J1 | Cor a 1, Cor a 9, Pru du 6, Ana o 1, Ana o 2, Ana o 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup+10 s 3, Cup a 3, Ch4A, Ch4-1, PT-1, LTP, Ara H 6, Ara H 8, and/or Ara H 9 |
| Cry J2 | Cor a 1, Cor a 9, Pru du 6, Ana o 1, Ana o 2, Ana o 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Cry J3 | Cor a 1, Cor a 9, Pru du 6, Ana o 1, Ana o 2, Ana o 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| CJP-4 | Cor a 1, Cor a 9, Pru du 6, Ana o 1, Ana o 2, Ana o 3, Jug n 1, Jug r 2, Amb a 1, Bet v 1-A, Canf 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-6, CJP-8, CPA63, CJP38, Cha o 1, Jun a 1, Jun v 1, Cup a 1, Jun o 1, Cups 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| CJP-6 | Cor a 1, Cor a 9, Pru du 6, Ana o 1, Ana o 2, Ana o 3, Jug n 1, Jug r 2, Amb a 1, Bet v 1-A, Canf 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| CJP-8 | Cor a 1, Cor a 9, Pru du 6, Ana o 1, Ana o 2, Ana o 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CPA63, CJP38, Cha o 1, Jun a 1, Jun |

TABLE 2-continued

| Allergen X | Can be combined with any one or more of the following Allergens: |
|---|---|
| | v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| CPA63 | Cor a 1, Cor a 9, Pru du 6, Ana 0 1, Ana 0 2, Ana 0 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| CJP38 | Cor a 1, Cor a 9, Pru du 6, Ana 0 1, Ana 0 2, Ana 0 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl+10 p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, Cha o 1, Jun a 1, Jun v 1, Cup a 1, Jun o 1, Cups 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Cha o 1 | Cor a 1, Cor a 9, Pru du 6, Ana 0 1, Ana 0 2, Ana 0 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Jun a 1 | Cor a 1, Cor a 9, Pru du 6, Ana 0 1, Ana 0 2, Ana 0 3, Jug n 1, Jug r 2, Amb a 1,+10 Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Jun v 1 | Cor a 1, Cor a 9, Pru du 6, Ana 0 1, Ana 0 2, Ana 0 3, Jug n 1, Jug r 2, Amb a 1, Bet v 1-A, Canf 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Cup a 1, Jun o 1, Cups 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Cup a 1 | Cor a 1, Cor a 9, Pru du 6, Ana 0 1, Ana 0 2, Ana 0 3, Jug n 1, Jug r 2, Amb a 1, Bet v 1-A, Canf 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Jun o 1 | Cor a 1, Cor a 9, Pru du 6, Ana 0 1, Ana 0 2, Ana 0 3, Jug n 1, Jug r 2, Amb a 1, Bet v 1-A, Canf 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Cup s 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Cup s 1 | Cor a 1, Cor a 9, Pru du 6, Ana 0 1, Ana 0 2, Ana 0 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cha o 2, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Cha o 2 | Cor a 1, Cor a 9, Pru du 6, Ana 0 1, Ana 0 2, Ana 0 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl |

TABLE 2-continued

| Allergen X | Can be combined with any one or more of the following Allergens: |
|---|---|
| | p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Jun a 2, Cup a 2, Jun a 3, Jun r 3, Cup s 3, Cup a 3, Ch4A, Ch4-1, PT-1, LTP, Ara H 6, Ara H 8, and/or Ara H 9 |
| Jun a 2 | Cor a 1, Cor a 9, Pru du 6, Ana O 1, Ana O 2, Ana O 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cups 1, Cha o 2, Cup a 2, Jun a 3, Jun r 3, Cup s 3, Cup a 3, Ch4A, Ch4-1, PT-1, LTP, Ara H 6, Ara H 8, and/or Ara H 9 |
| Cup a 2 | Cor a 1, Cor a 9, Pru du 6, Ana O 1, Ana O 2, Ana O 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Jun a 3, Jun r 3, Cup s 3, Cup a 3, Ch4A, Ch4-1, PT-1, LTP, Ara H 6, Ara H 8, and/or Ara H 9 |
| Jun a 3 | Cor a 1, Cor a 9, Pru du 6, Ana O 1, Ana O 2, Ana O 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun r 3, Cup s 3, Cup a 3, Ch4A, Ch4-1, PT-1, LTP, Ara H 6, Ara H 8, and/or Ara H 9 |
| Jun r 3 | Cor a 1, Cor a 9, Pru du 6, Ana O 1, Ana O 2, Ana O 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Cup s 3, Cup a 3, Ch4A, Ch4-1, PT-1, LTP, Ara H 6, Ara H 8, and/or Ara H 9 |
| Cup s 3 | Cor a 1, Cor a 9, Pru du 6, Ana O 1, Ana O 2, Ana O 3, Jug n 1, Jug r 2, Amb a 1, Bet v 1-A, Canf 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup a 3, Ch4A, Ch4-1, PT-1, LTP, Ara H 6, Ara H 8, and/or Ara H 9 |
| Cup a 3 | Cor a 1, Cor a 9, Pru du 6, Ana O 1, Ana O 2, Ana O 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Ch4A, Ch4-1, PT-1, LTP, Ara H 6, Ara H 8, and/or Ara H 9 |
| Ch4A | Cor a 1, Cor a 9, Pru du 6, Ana O 1, Ana O 2, Ana O 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4-1, PT-1, LTP, Ara H 6, Ara H 8, and/or Ara H 9 |
| Ch4-1 | Cor a 1, Cor a 9, Pru du 6, Ana O 1, Ana O 2, Ana O 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, PT-1, LTP, Ara H 6, Ara H 8, and/or Ara H 9 |

TABLE 2-continued

Allergen X  Can be combined with any one or more of the following Allergens:

| | |
|---|---|
| PT-1 | Cor a 1, Cor a 9, Pru du 6, Ana 0 1, Ana 0 2, Ana 0 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, LTP, Ara H 6, Ara H 8, and/or Ara H 9 |
| LTP | Cor a 1, Cor a 9, Pru du 6, Ana 0 1, Ana 0 2, Ana 0 3, Jug n 1, Jug r 2, Amb a 1, Bet v 1-A, Canf 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, Ara H 6, Ara H 8, and/or Ara H 9 |
| Ara H 6 | Cor a 1, Cor a 9, Pru du 6, Ana 0 1, Ana 0 2, Ana 0 3, Jug n 1, Jug r 2, Amb a 1, Bet v 1-A, Can f 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 8, and/or Ara H 9 |
| Ara H 8 | Cor a 1, Cor a 9, Pru du 6, Ana 0 1, Ana 0 2, Ana 0 3, Jug n 1, Jug r 2, Amb a 1, Bet v 1-A, Canf 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 15, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, and/or Ara H 9 |
| Ara H 9 | Cor a 1, Cor a 9, Pru du 6, Ana 0 1, Ana 0 2, Ana 0 3, Jug n 1, Jug r 2, Amb a 1, Bet v 1-A, Canf 1, Cyn d 1, Der F 1 (19-321), Der F 1 (99-321), Der P2, Der F 2, DerP1 (del), Fel d 1, Fel d 2, Fel d 4, Lit v 1, Lol p 5a, Phl p 1, Phl p 5, Der f 18, Zen-1, Cte f 1, Api m1, Api m2, Api m3, Api m5, Api m10, Ves v1, Ves v2, Ves v3, Ves v5, Pol d1, Pol d5, Ara H1, Ara H2, Ara H3, Cry J1, Cry J2, Cry J3, CJP-4, CJP-6, CJP-8, CPA63, CJP38, Cha o 1, Jun a 1, Jun v 1, Cup a 1, Jun o 1, Cup s 1, Cha o 2, Jun a 2, Cup a 2, Jun a 3, Jun r 3, Cup s 3, Cup a 3, Ch4A, Ch4-1, PT-1, LTP, Ara H 6, and/or Ara H 8 |

Assembly of Sequences Encoding Improved LAMP Constructs

Procedures for constructing improved LAMP Constructs comprising the allergen of interest are well known in the art (see e.g., Williams, et al., J. Cell Biol. 111: 955, 1990). DNA sequences encoding the desired segments can be obtained from readily available recombinant DNA materials such as those available from the American Type Culture Collection, 12301 Parklawn Drive, Rockville, Md. 20852, U.S.A., or from DNA libraries that contain the desired DNA.

For example, the DNA segments corresponding to the desired domain sequences can be assembled with appropriate control and signal sequences using routine procedures of recombinant DNA methodology. See, e.g., as described in U.S. Pat. No. 4,593,002, and Langford, et al., Molec. Cell. Biol. 6: 3191, 1986.

A DNA sequence encoding a protein or polypeptide can be synthesized chemically or isolated by one of several approaches. The DNA sequence to be synthesized can be designed with the appropriate codons for the desired amino acid sequence. In general, one will select preferred codons for the intended host in which the sequence will be used for expression. The complete sequence may be assembled from overlapping oligonucleotides prepared by standard methods and assembled into a complete coding sequence. See, e.g., Edge, Nature 292: 756, 1981; Nambair, et al. Science 223: 1299, 1984; Jay, et al., J. Biol. Chem. 259: 6311, 1984.

In one aspect, one or more of the nucleic acids encoding the domain sequences of the improved LAMP Construct are isolated individually using the polymerase chain reaction (M. A. Innis, et al., In PCR Protocols: A Guide to Methods and Applications, Academic Press, 1990). The domains are preferably isolated from publicly available clones known to contain them, but they may also be isolated from genomic DNA or cDNA libraries. Preferably, isolated fragments are bordered by compatible restriction endonuclease sites which allow an improved LAMP Construct encoding the allergen sequence to be constructed. This technique is well known to those of skill in the art. Domain sequences may be fused directly to each other (e.g., with no intervening sequences), or inserted into one another (e.g., where domain sequences are discontinuous), or may be separated by intervening sequences (e.g., such as linker sequences).

The basic strategies for preparing oligonucleotide primers, probes and DNA libraries, as well as their screening by nucleic acid hybridization, are well known to those of ordinary skill in the art. See, e.g., Sambrook, et al., 1989, supra; Perbal, 1984, supra. The construction of an appropriate genomic DNA or cDNA library is within the skill of the art. See, e.g., Perbal, 1984, supra. Alternatively, suitable DNA libraries or publicly available clones are available from suppliers of biological research materials, such as Clontech and Stratagene, as well as from public depositories such as the American Type Culture Collection.

Selection may be accomplished by expressing sequences from an expression library of DNA and detecting the expressed peptides immunologically. Clones which express peptides that bind to MHC II molecules and to the desired antibodies/T cell receptors are selected. These selection procedures are well known to those of ordinary skill in the art (see, e.g., Sambrook, et al., 1989, supra).

Once a clone containing the coding sequence for the desired polypeptide sequence has been prepared or isolated, the sequence can be cloned into any suitable vector, preferably comprising an origin of replication for maintaining the sequence in a host cell.

Nucleic Acid Delivery Vehicles

In one aspect, a vaccine composition comprising an improved LAMP Construct is introduced into a cell. The cell may be a host cell for replicating the nucleic acid or for expressing the improved LAMP Construct. Preferably, the host cell for expressing the improved LAMP Construct is an antigen presenting cell (described further below).

In preferred embodiments, the improved LAMP Construct further comprises a polynucleotide sequence for insertion into a target cell and an expression control sequence operably linked thereto to control expression of the polynucleotide sequence (e.g., transcription and/or translation) in the cell. Examples include plasmids, phages, autonomously replicating sequences (ARS), centromeres, and other sequences which are able to replicate or be replicated in vitro or in a host cell (e.g., such as a bacterial, yeast, or insect cell) and/or target cell (e.g., such as a mammalian cell, preferably an antigen presenting cell) and/or to convey the sequences encoding the improved LAMP Construct to a desired location within the target cell.

Recombinant expression vectors may be derived from micro-organisms which readily infect animals, including man, horses, cows, pigs, llamas, giraffes, dogs, cats or chickens. Preferred vectors include those which have already been used as live vaccines, such as vaccinia. These recombinants can be directly inoculated into a host, conferring immunity not only to the microbial vector, but also to express foreign allergens. Preferred vectors contemplated herein as live recombinant vaccines include RNA viruses, adenovirus, herpesviruses, poliovirus, and vaccinia and other pox viruses, as taught in Flexner, Adv. Pharmacol. 21: 51, 1990, for example.

Expression control sequences include, but are not limited to, promoter sequences to bind RNA polymerase, enhancer sequences or negative regulatory elements to bind to transcriptional activators and repressors, respectively, and/or translation initiation sequences for ribosome binding. For example, a bacterial expression vector can include a promoter such as the lac promoter and for transcription initiation, the Shine-Dalgarno sequence and the start codon AUG (Sambrook, et al., 1989, supra). Similarly, a eukaryotic expression vector preferably includes a heterologous, homologous, or chimeric promoter for RNA polymerase II, a downstream polyadenylation signal, the start codon AUG, and a termination codon for detachment of a ribosome.

Expression control sequences may be obtained from naturally occurring genes or may be designed. Designed expression control sequences include, but are not limited to, mutated and/or chimeric expression control sequences or synthetic or cloned consensus sequences. Vectors that contain both a promoter and a cloning site into which a polynucleotide can be operatively linked are well known in the art. Such vectors are capable of transcribing RNA in vitro or in vivo, and are commercially available from sources such as Stratagene (La Jolla, Calif.) and Promega Biotech (Madison, Wis.).

In order to optimize expression and/or transcription, it may be necessary to remove, add or alter 5' and/or 3' untranslated portions of the vectors to eliminate extra, or alternative translation initiation codons or other sequences that may interfere with, or reduce, expression, either at the level of transcription or translation. Alternatively, consensus ribosome binding sites can be inserted immediately 5' of the start codon to enhance expression. A wide variety of expression control sequences—sequences that control the expression of a DNA sequence operatively linked to it—may be used in these vectors to express the DNA sequences of this invention. Such useful expression control sequences include, for example, the early or late promoters of SV40, CMV, vaccinia, polyoma, adenovirus, herpes virus and other sequences known to control the expression of genes of mammalian cells, and various combinations thereof.

In one aspect, the improved LAMP Construct comprises an origin of replication for replicating the vector. Preferably, the origin functions in at least one type of host cell which can be used to generate sufficient numbers of copies of the sequence for use in delivery to a target cell. Suitable origins therefore include, but are not limited to, those which function in bacterial cells (e.g., such as *Escherichia* sp., *Salmonella* sp., *Proteus* sp., *Clostridium* sp., *Klebsiella* sp., *Bacillus* sp., *Streptomyces* sp., and *Pseudomonas* sp.), yeast (e.g., such as *Saccharamyces* sp. or *Pichia* sp.), insect cells, and mammalian cells. In one preferred aspect, an origin of replication is provided which functions in the target cell into which the nucleic acid delivery vehicle is introduced (e.g., a mammalian cell, such as a human cell). In another aspect, at least two origins of replication are provided, one that functions in a host cell and one that functions in a target cell.

The improved LAMP Construct may alternatively, or additionally, comprise sequences to facilitate integration of at least a portion of the nucleic acid deliver vector into a target cell chromosome. For example, the improved LAMP Construct may comprise regions of homology to target cell chromosomal DNA. In one aspect, the delivery vector comprises two or more recombination sites which flank a nucleic acid sequence encoding the improved LAMP Construct.

The vector may additionally comprise a detectable and/or selectable marker to verify that the vector has been successfully introduced in a target cell and/or can be expressed by the target cell. These markers can encode an activity, such as, but not limited to, production of RNA, peptide, or protein, or can provide a binding site for RNA, peptides, proteins, inorganic and organic compounds or compositions and the like.

Examples of detectable/selectable markers genes include, but are not limited to: DNA segments that encode products which provide resistance against otherwise toxic compounds (e.g., antibiotics); DNA segments that encode products which are otherwise lacking in the recipient cell (e.g., tRNA genes, auxotrophic markers); DNA segments that encode products which suppress the activity of a gene product; DNA segments that encode products which can be readily identified (e.g., phenotypic markers such as beta-galactosidase, a fluorescent protein (GFP, CFP, YFG, BFP, RFP, EGFP, EYFP, EBFP, dsRed, mutated, modified, or enhanced forms thereof, and the like), and cell surface proteins); DNA segments that bind products which are otherwise detrimental to cell survival and/or function; DNA segments that otherwise inhibit the activity of other nucleic acid segments (e.g., antisense oligonucleotides); DNA segments that bind products that modify a substrate (e.g., restriction endonucleases); DNA segments that can be used to isolate or identify a desired molecule (e.g., segments encoding specific protein binding sites); primer sequences; DNA segments, which when absent, directly or indirectly confer resistance or sensitivity to particular compounds; and/or DNA segments that encode products which are toxic in recipient cells.

The marker gene can be used as a marker for conformation of successful gene transfer and/or to isolate cells expressing transferred genes and/or to recover transferred genes from a cell. For example, in one aspect, the marker gene is used to isolate and purify antigen presenting cells expressing the improved LAMP Constructs.

Substantially similar genes maybe provided, e.g., genes with greater than about 50%, greater than about 70%, greater than 80%, greater than about 90%, and preferably, greater than about 95% identity to a known gene. Substantially similar domain sequences may initially be identified by selecting a sequence which specifically hybridizes to a domain sequence of interest under stringent hybridization conditions. Performing assays to determine the suitability of homologous, variant, or modified domain sequences is merely a matter of screening for sequences which express the appropriate activity. Such screening is routine in the art.

The improved LAMP Construct may be provided as naked nucleic acids or in a delivery vehicle associated with one or more molecules for facilitating entry of a nucleic acid into a cell. Suitable delivery vehicles include, but are not limited to: liposomal formulations, polypeptides, polysaccharides, lipopolysaccharides, viral formulations (e.g., including viruses, viral particles, artificial viral envelopes and the like), cell delivery vehicles, and the like.

Lipid-Based Formulations

Delivery vehicles designed to facilitate intracellular delivery of the improved LAMP Constructs must interact with both non-polar and polar environments (in or on, for example, the plasma membrane, tissue fluids, compartments within the cell, and the like). Therefore, preferably, delivery vehicles are designed to contain both polar and non-polar domains or a translocating sequence for translocating an improved LAMP Construct into a cell.

Compounds having polar and non-polar domains are termed amphiphiles. Cationic amphiphiles have polar groups that are capable of being positively charged at, or around, physiological pH for interacting with negatively charged polynucleotides such as DNA.

The improved LAMP Constructs described herein can be provided in formulations comprising lipid monolayers or bilayers to facilitate transfer of the vectors across a cell membrane. Liposomes or any form of lipid membrane, such as planar lipid membranes or the cell membrane of an intact cell, e.g., a red blood cell, can be used. Liposomal formulations can be administered by any means, including administration intravenously or orally.

Liposomes and liposomal formulations can be prepared according to standard methods and are well known in the art, see, e.g., Remington's; Akimaru, 1995, Cytokines Mol. Ther. 1: 197-210; Alving, 1995, Immunol. Rev. 145: 5-31; Szoka, 1980, Ann. Rev. Biophys. Bioeng. 9:467; U.S. Pat. Nos. 4,235,871; 4,501,728; and 4,837,028. In one aspect, the liposome comprises a targeting molecule for targeting a liposome:improved LAMP Construct complex to a particular cell type. In a particularly preferred aspect, a targeting molecule comprises a binding partner (e.g., a ligand or receptor) for a biomolecule (e.g., a receptor or ligand) on the surface of a blood vessel or a cell found in a target tissue.

Liposome charge is an important determinant in liposome clearance from the blood, with negatively charged liposomes being taken up more rapidly by the reticuloendothelial system (Juliano, 1975, Biochem. Biophys. Res. Commun. 63: 651) and thus having shorter half-lives in the bloodstream. Incorporating phosphatidylethanolamine derivatives enhances the circulation time by preventing liposomal aggregation. For example, incorporation of N-(omega-carboxy)acylamidophosphatidylethanolamines into large unilamellar vesicles of L-alpha-distearoylphosphatidylcholine dramatically increases the in vivo liposomal circulation lifetime (see, e.g., Ahl, 1997, Biochim. Biophys. Acta 1329: 370-382). Liposomes with prolonged circulation half-lives are typically desirable for therapeutic and diagnostic uses. For a general discussion of pharmacokinetics, see, e.g., Remington's, Chapters 37-39, Lee, et al., In Pharmacokinetic Analysis: A Practical Approach (Technomic Publishing AG, Basel, Switzerland 1996).

Typically, liposomes are prepared with about 5 to 15 mole percent negatively charged phospholipids, such as phosphatidylglycerol, phosphatidylserine or phosphatidyl-inositol. Added negatively charged phospholipids, such as phosphatidylglycerol, also serve to prevent spontaneous liposome aggregation, and thus minimize the risk of undersized liposomal aggregate formation. Membrane-rigidifying agents, such as sphingomyelin or a saturated neutral phospholipid, at a concentration of at least about 50 mole percent, and 5 to 15 mole percent of monosialylganglioside can also impart desirably liposome properties, such as rigidity (see, e.g., U.S. Pat. No. 4,837,028).

Additionally, the liposome suspension can include lipid-protective agents which protect lipids against free-radical and lipid-peroxidative damages on storage. Lipophilic free-radical quenchers, such as alpha-tocopherol and water-soluble iron-specific chelators, such as ferrioxianine, are preferred.

The improved LAMP Constructs of the invention can include multilamellar vesicles of heterogeneous sizes. For example, vesicle-forming lipids can be dissolved in a suitable organic solvent or solvent system and dried under vacuum or an inert gas to form a thin lipid film. If desired, the film can be redissolved in a suitable solvent, such as tertiary butanol, and then lyophilized to form a more homogeneous lipid mixture which is in a more easily hydrated powder like form. This film is covered with an aqueous solution of the peptide or polypeptide complex and allowed to hydrate, typically over a 15 to 60 minute period with agitation. The size distribution of the resulting multilamellar vesicles can be shifted toward smaller sizes by hydrating the lipids under more vigorous agitation conditions or by adding solubilizing detergents such as deoxycholate. The hydration medium preferably comprises the nucleic acid at a concentration which is desired in the interior volume of the liposomes in the final liposome suspension.

Following liposome preparation, the liposomes can be sized to achieve a desired size range and relatively narrow distribution of liposome sizes. One preferred size range is about 0.2 to 0.4 microns, which allows the liposome suspension to be sterilized by filtration through a conventional filter, typically a 0.22 micron filter. Filter sterilization can be carried out on a high throughput basis if the liposomes have been sized down to about 0.2 to 0.4 microns. Several techniques are available for sizing liposome to a desired size (see, e.g., U.S. Pat. No. 4,737,323).

Suitable lipids include, but are not limited to, DOTMA (Felgner, et al., 1987, Proc. Natl. Acad. Sci. USA 84: 7413-7417), DOGS or Transfectain™ (Behr, et al., 1989, Proc. Natl. Acad. Sci. USA 86: 6982-6986), DNERIE or DORIE (Felgner, et al., Methods 5: 67-75), DC-CHOL (Gao and Huang, 1991, BBRC 179: 280-285), DOTAP™ (McLachlan, et al., 1995, Gene Therapy 2: 674-622), Lipofectamine™. and glycerolipid compounds (see, e.g., EP901463 and WO98/37916).

Other molecules suitable for complexing with the improved LAMP Constructs include cationic molecules, such as, polyamidoamine (Haensler and Szoka, 1993, Bioconjugate Chem. 4: 372-379), dendritic polysine (WO 95/24221), polyethylene irinine or polypropylene h-nine (WO 96/02655), polylysine (U.S. Pat. No. 5,595,897; FR 2 719 316), chitosan (U.S. Pat. No. 5,744,166), DNA-gelatin coarcervates (see, e.g., U.S. Pat. Nos. 6,207,195; 6,025,337; 5,972,707) or DEAE dextran (Lopata, et al., 1984, Nucleic Acid Res. 12: 5707-5717).

Viral-Based Gene Delivery Vehicles

In one aspect, the improved LAMP Construct delivery vehicle comprises a virus or viral particle. In this aspect, preferably, the improved LAMP Construct comprises a viral vector. Viral vectors, such as retroviruses, adenoviruses, adeno-associated viruses and herpes viruses, are often made up of two components, a modified viral genome and a coat structure surrounding it (see, e.g., Smith et al., 1995, Ann. Rev. Microbiol. 49: 807-838), although sometimes viral vectors are introduced in naked form or coated with proteins other than viral proteins. Most current vectors have coat structures similar to a wild-type virus. This structure packages and protects the viral nucleic acid and provides the means to bind and enter target cells.

Preferably, viral vectors comprising the improved LAMP Constructs described herein are modified from wild-type viral genomes to disable the growth of the virus in a target cell while enabling the virus to grow in a host cell (e.g., such as a packaging or helper cell) used to prepare infectious particles. Vector nucleic acids generally essential cis-acting viral sequences for replication and packaging in a helper line and expression control sequences for regulating the expression of a polynucleotide being delivered to a target cell. Other viral functions are expressed in trans in specific packaging or helper cell lines as are known in the art.

Preferred improved LAMP Constructs are viral vectors derived from a virus selected from the group consisting of herpes viruses, cytomegaloviruses, foamy viruses, lentiviruses, Semliki forrest virus, AAV (adeno-associated virus), poxviruses, adenovirases and retroviruses. Such viral vectors are well known in the art.

In one preferred aspect, a viral vector used is an adenoviral vector. The adenoviral genome consists of a linear double-stranded DNA molecule of approximately 36 kb carrying more than about thirty genes necessary to complete the viral replication cycle. The early genes are divided into 4 regions (E1 to E4) that are essential for viral replication with the exception of the E3 region, which is believed to modulate the anti-viral host immune response. The E1 region (EIA and EIB) encodes proteins responsible for the regulation of transcription of the viral genome. Expression of the E2 region genes (E2A and E2B) leads to the synthesis of the polypeptides needed for viral replication. The proteins encoded by the E3 region prevent cytolysis by cytotoxic T cells and tumor necrosis factor (Wold and Gooding, 1991, Virology 184: 1-8). The proteins encoded by the E4 region are involved in DNA replication, late gene expression and splicing and host cell shut off (Halbert, et al., 1985, J. Virol. 56: 250-257). The late genes generally encode structural proteins contributing to the viral capsid. In addition, the adenoviral genome carries at cis-acting 5' and 3' ITRs (Inverted Terminal Repeat) and packaging sequences essential for DNA replication. The ITRs harbor origins of DNA replication while the encapsidation region is required for the packaging of adenoviral DNA into infectious particles.

Adenoviral vectors can be engineered to be conditionally replicative (CRAd vectors) in order to replicate selectively in specific cells (e.g., such as proliferative cells) as described in Heise and Kim (2000, J. Clin. Invest. 105: 847-85 1). In another aspect, an adenoviral vector is replication-defective for the E1 function (e.g., by total or partial deletion or mutagenesis of E1). The adenoviral backbone of the vector may comprise additional modifications (deletions, insertions or mutations in one or more viral genes). An example of an E2 modification is illustrated by the thermosensitive mutation localized on the DBP (DNA Binding Protein) encoding gene (Ensinger et al., 1972, J. Virol. 10: 328-339). The adenoviral sequence may also be deleted of all or part of the E4 region (see, e.g., EP 974 668; Christ, et al., 2000, Human Gene Ther. 11: 415-427; Lusky, et al., 1999, J. Virol. 73: 8308-8319). Additional deletions within the non-essential E3 region may allow the size of the polynucleotide being delivered to be increased (Yeh, et al., 1997, FASEB Journal 11: 615 623). However, it may be advantageous to retain all or part of the E3 sequences coding for polypeptides (e.g., such as gp19k) allowing the virus to escape the immune system (Gooding, et al., 1990, Critical Review of Immunology 10: 53-71) or inflammatory reactions (EP 00440267.3).

Second generation vectors retaining the ITRs and packaging sequences and comprising substantial genetic modifications to abolish the residual synthesis of the viral antigens also may be used in order to improve long-term expression of the expressed gene in the transduced cells (see, e.g., WO 94/28152; Lusky, et al., 1998, J. Virol 72: 2022-2032).

The improved LAMP Constructs being introduced into the cell may be inserted in any location of the viral genome, with the exception of the cis-acting sequences. Preferably, it is inserted in replacement of a deleted region (E1, E3 and/or E4), preferably, within a deleted E1 region.

Adenoviruses can be derived from any human or animal source, in particular canine (e.g. CAV-1 or CAV-2 Genbank ref. CAVIGENOM and CAV77082, respectively), avian (Genbank ref AAVEDSDNA), bovine (such as BAV3; Reddy, et al., 1998, J. Virol. 72: 1394 1402), murine (Genbank ref ADRMUSMAVI), ovine, feline, porcine or simian sources or alternatively, may be a hybrid virus. Any serotype can be employed. However, the human adenoviruses of the C sub-group are preferred, especially adenoviruses 2 (Ad2) and 5 (Ad5). Such viruses are available, for example, from the ATCC.

Adenoviral particles or empty adenoviral capsids also can be used to transfer improved LAMP Constructs by a virus-mediated cointernalization process as described in U.S. Pat. No. 5,928,944. This process can be accomplished in the presence of cationic agent(s) such as polycarbenes or lipid vesicles comprising one or more lipid layers.

Adenoviral particles may be prepared and propagated according to any conventional technique in the field of the art (e.g., WO 96/17070) using a complementation cell line or a helper virus, which supplies in trans the missing viral genes necessary for viral replication. The cell lines 293 (Graham et al., 1977, J. Gen. Virol. 36: 59-72) and PERC6 (Fallaux et al., 1998, Human Gene Therapy 9: 1909-1917) are commonly used to complement E1 deletions. Other cell lines have been engineered to complement defective vectors (Yeh, et al., 1996, J. Virol. 70: 559-565; Kroughak and Graham, 1995, Human Gene Ther. 6: 1575-1586; Wang, et al., 1995, Gene Ther. 2: 775-783; Lusky, et al., 1998, J. Virol. 72: 2022-203; EP 919627 and WO 97/04119). The adenoviral particles can be recovered from the culture supernatant but also from the cells after lysis and optionally further purified according to standard techniques (e.g., chromatography, ultracentrifugation, as described in WO 96/27677, WO 98/00524 WO 98/26048 and WO 00/50573).

Cell-type specific targeting may be achieved with vectors derived from adenoviruses having a broad host range by the modification of viral surface proteins. For example, the specificity of infection of adenoviruses is determined by the attachment to cellular receptors present at the surface of permissive cells. In this regard, the fiber and penton present at the surface of the adenoviral capsid play a critical role in cellular attachment (Defer, et al., 1990, J. Virol. 64: 3661-3673). Thus, cell targeting of adenoviruses can be carried out by genetic modification of the viral gene encoding fiber and/or penton, to generate modified fiber and/or penton capable of specific interaction with unique cell surface receptors. Examples of such modifications are described in Wickam, et al., 1997, J. Virol. 71: 8221-8229; Arriberg, et al., 1997, Virol. Chem 268: 6866-6869; Roux, et al., 1989, Proc. Natl. Acad. Sci. USA 86: 9079-9083; Miller and Vile, 1995, FASEB J. 9: 190-199; WO 93/09221, and in WO 95/28494.

In a particularly preferred aspect, adeno-associated viral sequences are used as vectors. Vectors derived from the human parvovirus AAV-2 (adeno-associated virus type 2) are among the most promising gene delivery vehicles currently being developed. Several of the features of this system for packaging a single-stranded DNA suggest it as a possible alternative to naked DNA for delivery. A primary attractive feature, in contrast to other viral vectors such as vaccinia or adenovirus, is that AAV vectors do not express any viral genes. The only viral DNA sequences included in the vaccine construct are the 145 bp inverted terminal repeats (ITR). Thus, as in immunization with naked DNA, the only gene expressed is that of the allergen, or allergen chimera. Additionally, AAV vectors are known to transduce both dividing and non-dividing cells, such as human peripheral blood monocyte-derived dendritic cells, with persistent transgene expression, and with the possibility of oral and intranasal delivery for generation of mucosal immunity. Moreover, the amount of DNA required appears to be much less by several orders of magnitude, with maximum responses at doses of $10^{10}$ to $10^{11}$ particles or copies of DNA in contrast to naked DNA doses of 50 µg or about $10^{15}$ copies.

In one aspect, AAV vectors are packaged by co-transfection of a suitable cell line (e.g., human 293 cells) with the DNA contained in the AAV ITR chimeric protein encoding constructs and an AAV helper plasmid ACG2 containing the AAV coding region (AAV rep and cap genes) without the ITRs. The cells are subsequently infected with the adenovirus Ad5. Vectors can be purified from cell lysates using methods known in the art (e.g., such as cesium chloride density gradient ultracentrifugation) and are validated to ensure that they are free of detectable replication-competent AAV or adenovirus (e.g., by a cytopathic effect bioassay). AAV titer may be determined by quantitative PCR with virus DNA samples prepared after digestion with proteinase K. Preferably, vector titers produced by such a method are approximately $5 \times 10^{12}$ to $1 \times 10^{13}$ DNase resistant particles per ml.

In other aspects, retroviral vectors are used. Retroviruses are a class of integrative viruses which replicate using a virus-encoded reverse transcriptase, to replicate the viral RNA genome into double stranded DNA which is integrated into chromosomal DNA of the infected cells (e.g., target cells). Such vectors include those derived from murine leukemia viruses, especially Moloney (Gilboa, et al., 1988, Adv. Exp. Med. Biol. 241: 29) or Friend's FB29 strains (WO 95/01447). Generally, a retroviral vector is deleted of all or part of the viral genes gag, pol and env and retains 5' and 3' LTRs and an encapsidation sequence. These elements may be modified to increase expression level or stability of the retroviral vector. Such modifications include the replacement of the retroviral encapsidation sequence by one of a retrotransposon such as VL30 (see, e.g., U.S. Pat. No. 5,747,323). Preferably, the improved LAMP Construct is inserted downstream of the encapsidation sequence, preferably in opposite direction relative to the retroviral genome. Cell specific targeting may be achieved by the conjugation of antibodies or antibody fragments to the retroviral envelope protein as is known in the art.

Retroviral particles are prepared in the presence of a helper virus or in an appropriate complementation (packaging) cell line which contains integrated into its genome the retroviral genes for which the retroviral vector is defective (e.g. gag/pol and env). Such cell lines are described in the prior art (Miller and Rosman, 1989, BioTechniques 7: 980; Danos and Mulligan, 1988, Proc. Natl. Acad. Sci. USA 85: 6460; Markowitz, et al., 1988, Virol. 167: 400). The product of the env gene is responsible for the binding of the viral particle to the viral receptors present on the surface of the target cell and, therefore determines the host range of the retroviral particle. in the context of the invention, it is advantageous to use a packaging cell line, such as the PA317 cells (ATCC CRL 9078) or 293EI6 (WO97/35996) containing an amphotropic envelope protein, to allow infection of human and other species' target cells. The retroviral particles are preferably recovered from the culture supernatant and may optionally be further purified according to standard techniques (e.g. chromatography, ultracentrifugation).

Other suitable viruses include poxviruses. The genome of several members of poxyiridae has been mapped and sequenced. A poxyiral vector may be obtained from any member of the poxyiridae, in particular canarypox, fowlpox and vaccinia virus. Suitable vaccinia viruses include, but are not limited to, the Copenhagen strain (Goebel, et al., 1990, Virol. 179: 247-266; Johnson, et al., 1993, Virol. 196: 381-401), the Wyeth strain and the modified Ankara (MVA) strain (Antoine, et al., 1998, Virol. 244: 365-396). The general conditions for constructing a vaccinia virus vector are known in the art (see, e.g., EP 83 286 and EP 206 920; Mayr et al., 1975, Infection 3: 6-14; Sutter and Moss, 1992, Proc. Natl. Acad. Sci. USA 89: 10847-10851). Preferably, the polynucleotide of interest is inserted within a non-essential locus such as the noncoding intergenic regions or any gene for which inactivation or deletion does not significantly impair viral growth and replication.

Poxyiral particles are prepared as described in the art (Piccini, et al., 1987, Methods of Enzymology 153: 545-563; U.S. Pat. Nos. 4,769,330; 4,772,848; 4,603,112; 5,100,587 and 5,179,993). Generally, a donor plasmid is constructed, amplified by growth in E. coli and isolated by conventional procedures. Then, it is introduced into a suitable cell culture (e.g. chicken embryo fibroblasts) together with a poxvirus genome, to produce, by homologous recombination, poxyiral particles. These can be recovered from the culture supernatant or from the cultured cells after a lysis step (e.g., chemical lysis, freezing/thawing, osmotic shock, sonication and the like). Consecutive rounds of plaque purification can be used to remove contaminating wild type virus. Viral particles can then be purified using the techniques known in the art (e.g., chromatographic methods or ultracentrifugation on cesium chloride or sucrose gradients).

The use of vaccinia as a live virus vaccine in the global campaign to eradicate smallpox made vaccinia an obvious choice for development as a live recombinant vaccine vector. Live recombinant vaccinia viruses expressing close to 100 different foreign proteins have been reported, and a number of these are effective experimental vaccines (reviewed by Moss and Flexner, 1987). Vaccinia is particularly versatile as an expression vector because of its large genomic size, capability of accepting at least 25,000 base pairs of foreign DNA, and its ability to infect most eukaryotic cell types, including insect cells (ibid.). Unlike other DNA viruses, poxviruses replicate exclusively in the cytoplasm of infected cells, reducing the possibility of genetic exchange of recombinant viral DNA with the host chromosome. Recombinant vaccinia vectors have been shown to properly process and express proteins from a variety of sources including man, other mammals, parasites, RNA and DNA viruses, bacteria and bacteriophage.

The expression of DNA encoding a foreign protein is controlled by host virus regulatory elements, including upstream promoter sequences and, where necessary, RNA processing signals. Insertion of foreign DNA into nonessential regions of the vaccinia virus genome has been carried out by homologous recombination (Panicali, et al., Proc. Nat'l. Acad. Sci, USA, 79: 4927, 1982; Mackett, et al., Proc. Nat'l. Acad. Sci. USA, 79: 7415, 1982).

Expression of allergens by the improved LAMP Construct may occur because of transcriptional regulatory elements at or near the site of insertion or by more precise genetic engineering. Plasmid vectors that greatly facilitate insertion and expression of foreign genes have been constructed (Mackett, et al., J. Virol, 49: 857, 1982). These vectors contain an expression site, composed of a vaccinia transcriptional promoter and one or more unique restriction endonuclease sites for insertion of the foreign coding sequence flanked by DNA from a nonessential region of the vaccinia genome. The choice of promoter determines both the time (e.g., early or late) and level of expression, whereas the flanking DNA sequence determines the site of homologous recombination.

Only about one in a thousand virus particles produced by this procedure is a recombinant. Although recombinant virus plaques can be identified by DNA hybridization, efficient selection procedures have been developed. By using segments of nonessential vaccinia virus thymidine kinase (TK) gene as flanking sequences, the foreign gene recombines into the TK locus and by insertion inactivates the TK gene. Selection of TK virus is achieved by carrying out the virus plaque assay in TK cells in the presents of 5-bromodeoxyuridine. Phosphorylation of the nucleoside analogue and consequent lethal incorporation into viral DNA occurs only in cells infected with TK+parental virus. Depending on the efficiency of the transfection and recombination, up to 80 of the plaques are desired recombinants, and the rest are spontaneous TK mutants. Plasmid vectors that contain the E. coli beta-galactosidase gene, as well as an expression site for a second gene, permit an alternative method of distinguishing recombinant virus from parental virus (Chakrabarti, et al., Mol. Cell. Biol., 5: 3403, 1985). Plaques formed by such recombinants can be positively identified by the blue color that forms upon addition of an appropriate indicator. By combining both TK selection and beta-galactosidase expression, recombinant virus is readily and quickly isolated. The recombinants are then amplified by propagation in suitable cell lines and expression of the inserted gene is checked by appropriate enzymological, immunological or physical procedures.

An upper limit to the amount of genetic information that can be added to the vaccinia virus genome is not yet known. However, the addition of nearly 25,000 base pairs of foreign DNA had no apparent deleterious effect on virus yield (Smith, et al., Gene, 25:21, 1983). Were it necessary, large segments of the vaccinia virus genome could be deleted to provide additional capacity (Moss, et al., J. Virol. 40: 387, 1981).

Viral capsid molecules may include targeting moieties to facilitate targeting and/or entry into cells. Suitable targeting molecules, include, but are not limited to: chemical conjugates, lipids, glycolipids, hormones, sugars, polymers (e.g. PEG, polylysine, PEI and the like), peptides, polypeptides (see, e.g., WO 94/40958), vitamins, antigens, lectins, antibodies and fragments thereof. Preferably, such targeting molecules recognize and bind to cell-specific markers, tissue-specific markers, cellular receptors, viral antigens, antigenic epitopes or tumor-associated markers.

Compositions comprising an improved LAMP Construct based on viral particles may be formulated in the form of doses of between 10 and $10^{14}$ i.u. (infectious units), and preferably, between 10 and $10^{11}$ i.u. The titer may be determined by conventional techniques. The doses of LAMP Constructs are preferably comprised between 0.01 and 10 mg/kg, more especially between 0.1 and 2 mg/kg.

Self-Replicating RNA

Self-replicating RNA virus vectors can also be constructed using the improved LAMP Constructs as described herein. For example, alphaviruses, flavivuses, measle virus and rhabdoviruses can be used to generate self-replicating RNA virus vaccines. Preferred strains of self-replicating RNA viruses include, but are not limited to rabies virus (RABV), vesicular stomatisitis virus (VSV), West Nile virus, Kunjin virus, Semliki Forest virus (SFV), Sindbis virus (SIN) and/or Venezuelan equine encephalitis virus (VEE).

Self-replicating RNA viruses express the native antigen upon delivery into tissue, thus mimicking live attenuated vaccines without having the risk of reversion to pathogenicity. They also stimulate the innate immune system, thus potentiating responses. See, e.g., Ljungberg, K. "*Self-replicating alphavirus RNA vaccines*," Expert Rev Vaccines (2):177-94 (2015); Lundstrom, K., "*Oncolytic Alphaviruses in Cancer Immunotherapy*", Vaccines 5:9 (2017); Lundstrom, K. "*Replicon RNA Viral Vectors as Vaccines*," Vaccines 4:39 (2016) (hereby incorporated by reference in their entirety). Use of self-replicating vaccines comprising the improved LAMP Constructs described herein can also be used in prime-boost protocols.

Moreover, self-replicating RNA viruses can also be encapsulated by liposomes, as described herein, to improve delivery and targeting. Immunization with self-replicating RNA viruses comprising the improved LAMP Constructs described herein may provide higher transient expression levels of allergens resulting in generation of neutralizing antibody responses and protection against lethal challenges under safe conditions.

Cell-Based Delivery Vehicles

The improved LAMP Constructs according to the invention can be delivered to target cells by means of other cells ("delivery cells") which comprise the constructs. Methods for introducing constructs into cells are known in the art and include microinjection of DNA into the nucleus of a cell (Capechi, et al., 1980, Cell 22: 479-488); transfection with CaPO$_4$ (Chen and Okayama, 1987, Mol. Cell Biol. 7: 2745 2752), electroporation (Chu, et al., 1987, Nucleic Acid Res. 15: 1311-1326); lipofection/liposome fusion (Feigner, et al., 1987, Proc. Natl. Acad. Sci. USA 84: 7413-7417) and particle bombardment (Yang, et al., 1990, Proc. Natl. Acad. Sci. USA 87: 9568-9572). Suitable cells include autologous and non-autologous cells, and may include xenogenic cells. Delivery cells may be induced to deliver their contents to the target cells by inducing their death (e.g., by providing inducible suicide genes to these cells).

Accessory Molecules

The compositions comprising the improved LAMP Constructs according to the invention may comprise one or more accessory molecules for facilitating the introduction of an improved LAMP Construct into a cell and/or for enhancing a particular therapeutic effect and/or enhancing antibody production.

In addition, the composition comprising the improved LAMP Construct according to the present invention may include one or more stabilizing substance(s), such as lipids, nuclease inhibitors, hydrogels, hyaluronidase (WO 98/53853), collagenase, polymers, chelating agents (EP 890362), in order to inhibit degradation within the animal/human body and/or improve transfection/infection of the vector into a target cell. Such substances may be used alone or in combination (e.g., cationic and neutral lipids).

It has also been shown that adenovirus proteins are capable of destabilizing endosomes and enhancing the uptake of DNA into cells. The mixture of adenoviruses to solutions containing a lipid-complexed DNA vector or the binding of DNA to polylysine covalently attached to adenoviruses using protein cross-linking agents may substantially improve the uptake and expression of an improved LAMP Construct (see, e.g., Curiel, et al., 1992, Am. I. Respir. Cell. Mol. Biol. 6: 247-252).

Host Cells

Improved LAMP Constructs according to the invention can be expressed in a variety of host cells, including, but not limited to: prokaryotic cells (e.g., *E. coli, Staphylococcus* sp., *Bacillus* sp.); yeast cells (e.g., *Saccharomyces* sp.); insect cells; nematode cells; plant cells; amphibian cells (e.g., *Xenopus*); avian cells; and mammalian cells (e.g., human cells, mouse cells, mammalian cell lines, primary cultured mammalian cells, such as from dissected tissues).

The molecules can be expressed in host cells isolated from an organism, host cells which are part of an organism, or host cells which are introduced into an organism. In one aspect, improved LAMP Constructs are expressed in host cells in vitro, e.g., in culture. In another aspect, improved LAMP Constructs are expressed in a transgenic organism (e.g., a transgenic mouse, rat, rabbit, pig, primate, etc.) that comprises somatic and/or germline cells comprising nucleic acids encoding the improved LAMP Constructs. Methods for constructing transgenic animals are well known in the art and are routine.

Improved LAMP Constructs also can be introduced into cells in vitro, and the cells (e.g., such as stem cells, hematopoietic cells, lymphocytes, and the like) can be introduced into the host organism. The cells may be heterologous or autologous with respect to the host organism. For example, cells can be obtained from the host organism, improved LAMP Constructs introduced into the cells in vitro, and then reintroduced into the host organism.

Antigen Presenting Cells

In a preferred aspect of the invention, an improved LAMP Construct as described herein is introduced into a natural or engineered antigen presenting cell.

The term "antigen presenting cell" (APC) as used herein intends any cell which presents on its surface an antigen (e.g., an allergen) in association with a major histocompatibility complex molecule, preferably a class II molecule, or portion thereof. Examples of suitable APCs are discussed in detail below and include, but are not limited to, whole cells such as macrophages, dendritic cells, B cells, hybrid APCs, and foster antigen presenting cells. Methods of making hybrid APCs are described and known in the art.

Dendritic cells (DCs) are potent antigen-presenting cells. It has been shown that DCs provide all the signals required for T cell activation and proliferation. These signals can be categorized into two types. The first type, which gives specificity to the immune response, is mediated through interaction between the T-cell receptor/CD3 ("TCR/CD3") complex and an allergenic peptide presented by a major histocompatibility complex ("MHC" defined above) class I or II protein on the surface of APCs. This interaction is necessary, but not sufficient, for T cell activation to occur. In fact, without the second type of signals, the first type of signals can result in T cell anergy. The second type of signals, called co-stimulatory signals, is neither antigen-specific nor MHC-restricted, and can lead to a full proliferation response of T cells and induction of T cell effector functions in the presence of the first type of signals.

Several molecules have been shown to enhance co-stimulatory activity. These include, but are not limited to, heat stable antigen (HSA), chondroitin sulfate-modified MHC invariant chain (Ii-CS), intracellular adhesion molecule I (ICAM-1), and B7 co-stimulatory molecule on the surface of APCs and its counter-receptor CD28 or CTLA-4 on T cells.

Other important co-stimulatory molecules are CD40, CD54, CD80, CD86. As used herein, the term "co-stimulatory molecule" encompasses any single molecule or combination of molecules which, when acting together with a peptide/MHC complex bound by a TCR on the surface of a T cell, provides a co-stimulatory effect which achieves activation of the T cell that binds the peptide. The term thus encompasses B7, or other co-stimulatory molecule(s) on an APC, fragments thereof (alone, complexed with another molecule(s), or as part of a fusion protein) which, together with peptide/MHC complex, binds to a cognate ligand and result in activation of the T cell when the TCR on the surface of the T cell specifically binds the peptide. Co-stimulatory molecules are commercially available from a variety of sources, including, for example, Beckman Coulter.

In one aspect of the invention, the method described in Romani et al., J. Immunol. Methods 196: 135-151, 1996, and Bender et al, J. Immunol. Methods 196: 121-135, 1996, are used to generate both immature and mature dendritic cells from the peripheral blood mononuclear cells (PBMCs) of a mammal, such as a murine, simian or human. Briefly, isolated PBMCs are pre-treated to deplete T- and B-cells by means of an immunomagnetic technique. Lymphocyte-depleted PBMC are then cultured for in RPMI medium 9 e.g., about 7 days), supplemented with human plasma (preferably autologous plasma) and GM-CSF/IL-4, to generate dendritic cells. Dendritic cells are nonadherent when compared to their monocyte progenitors. Thus, on approximately day 7, non-adherent cells are harvested for further processing.

The dendritic cells derived from PBMC in the presence of GM-CSF and IL-4 are immature, in that they can lost the nonadherence property and revert back to macrophage cell fate if the cytokine stimuli are removed from the culture. The dendritic cells in an immature state are very effective in processing native protein antigens for the MHC class II restricted pathway (Romani, et al., J. Exp. Med. 169:1169, 1989). Further maturation of cultured dendritic cells is accomplished by culturing for 3 days in a macrophage-conditioned medium (CM), which contains the necessary maturation factors. Mature dendritic cells are less able to capture new proteins for presentation but are much better at stimulating resting T cells (both CD4 and CD8) to grow and differentiate.

Mature dendritic cells can be identified by their change in morphology, such as the formation of more motile cytoplasmic processes; by their nonadherence; by the presence of at least one of the following markers: CD83, CD68, HLA-DR or CD86; or by the loss of Fc receptors such as CD 115 (reviewed in Steinman, Annu. Rev. Immunol. 9: 271, 1991). Mature dendritic cells can be collected and analyzed using typical cytofluorography and cell sorting techniques and devices, such as FACScan and FACStar. Primary antibodies used for flow cytometry are those specific to cell surface antigens of mature dendritic cells and are commercially available. Secondary antibodies can be biotinylated Igs followed by FITC- or PE-conjugated streptavidin.

Alternatively, others have reported that a method for upregulating (activating) dendritic cells and converting monocytes to an activated dendritic cell phenotype. This method involves the addition of calcium ionophore to the culture media convert monocytes into activated dendritic cells. Adding the calcium 21 ionophore A23187, for example, at the beginning of a 24-48 hour culture period resulted in uniform activation and dendritic cell phenotypic conversion of the pooled "monocyte plus DC" fractions: characteristically, the activated population becomes uniformly CD 14 (Leu M3) negative, and upregulates HLA-DR, HLA-DQ, ICAM-1,137.1, and 137.2. Furthermore, this activated bulk population functions as well on a small numbers basis as a further purified. Specific combination(s) of cytokines have been used successfully to amplify (or partially substitute) for the activation/conversion achieved with calcium ionophore: these cytokines include but are not limited to G-CSF, GM-CSF, IL-2, and IL-4. Each cytokine when given alone is inadequate for optimal upregulation.

The second approach for isolating APCs is to collect the relatively large numbers of precommitted APCs already circulating in the blood. Previous techniques for isolating committed APCs from human peripheral blood have involved combinations of physical procedures such as metrizamide gradients and adherence/nonadherence steps (Freudenthal et al. PNAS 87: 7698-7702, 1990); Percoll gradient separations (Mehta-Damani, et al., J. Immunol. 153: 996-1003, 1994); and fluorescence activated cell sorting techniques (Thomas et al., J. Immunol. 151: 6840-52, 1993).

There are many other methods routine in the art for isolating professional antigen presenting cells (or their precursors) and that such methods and others which may be developed are not limiting and are encompassed within the scope of the invention.

In one embodiment, the APCs and therefore the cells presenting one or more allergens as described herein are autologous. In another embodiment, the APCs presenting the allergens as described herein are allogeneic, i.e., derived from a different subject.

As discussed herein, improved LAMP Constructs can be introduced into APCs using the methods described above or others known in the art, including, but not limited to, transfection, electroporation, fusion, microinjection, viral-based delivery, or cell based delivery. Arthur et al., Cancer Gene Therapy 4(1): 17-25, 1997, reports a comparison of gene transfer methods in human dendritic cells.

Known, partial and putative human leukocyte antigen (HLA), the genetic designation for the human MHC, amino acid and nucleotide sequences, including the consensus sequence, are published (see, e.g., Zemmour and Parham, Immunogenetics 33: 310-320, 1991), and cell lines expressing HLA variants are known and generally available as well, many from the American Type Culture Collection ("ATCC"). Therefore, using PCR, MHC class II-encoding nucleotide sequences are readily operatively linked to an expression vector of this invention that is then used to transform an appropriate cell for expression therein.

Professional APCs can be used, such as macrophages, B cells, monocytes, dendritic cells, and Langerhans cells. These are collected from the blood or tissue of 1) an autologous donor; 2) a heterologous donor having a different HLA specificity then the host to be treated; or 3) from a xenogeneic donor of a different species using standard procedures (Coligan, et. al., Current Protocols in Immunology, sections 3 and 14, 1994). The cells may be isolated from a normal host or a patient having an infectious disease, cancer, autoimmune disease, or allergy.

Professional APCs may be obtained from the peripheral blood using leukopheresis and "FICOLL/HYPAQUE" density gradient centrifugation (stepwise centrifugation through Ficoll and discontinuous Percoll density gradients). Procedures are utilized which avoid the exposure of the APCs to allergens which could be internalized by the APCs, leading to activation of T cells not specific for the Allergen X (SEQ ID NO:Y) of interest.

Cells which are not naturally antigen presenting can be engineered to be antigen presenting by introducing sequences encoding appropriate molecules. For example, nucleic acid sequences encoding MHC class II molecules, accessory molecules, co-stimulatory molecules and antigen processing assisting molecules can be introduced after direct synthesis, cloning, purification of DNA from cells containing such genes, and the like. One expedient means to obtain genes for encoding the molecules used in the improved LAMP Constructs and methods described herein is by polymerase chain reaction (PCR) amplification on selected nucleic acid templates with selected oligonucleotide primer pairs. For example, epithelial cells, endothelial cells, tumor cells, fibroblasts, activated T cells, eosinophils, keratinocytes, astrocytes, microglial cells, thymic cortical epithelial cells, Schwann cells, retinal pigment epithelial cells, myoblasts, vascular smooth muscle cells, chondrocytes, enterocytes, thyrocytes and kidney tubule cells can be used. These may be primary cells recently explanted from a host and not extensively passaged in cell culture to form an established cell line, or established cell lines that are relatively homogeneous and capable of proliferating for many generations or indefinitely.

Cells that are not professional APCs are isolated from any tissue of an autologous donor; a heterologous donor or a xenogeneic donor, where they reside using a variety of known separation methods (Darling, Animal Cells: Culture and Media. J. Wiley, New York, 1994; Freshney, Culture of Animal Cells. Alan R. Liss, Inc., New York, 1987). Non-autologous cells, e.g., heterologous or xenogeneic cells, can be engineered ex vivo to express HLA class I and class II molecules that match known human HLA specificities. These cells can then be introduced into a human subject matching the HLA specificity of the engineered cells. The cells are further engineered ex vivo to express one or more LAMP Constructs according to the invention.

The engineered cells are maintained in cell culture by standard cell culture methods (Darling, Animal Cells: Culture and Media". J. Wiley, New York, 1994; Freshney, Culture of Animal Cells". Alan R. Liss, Inc., New York, 1987). Cell lines for use in the present invention are obtained from a variety of sources (e.g., ATCC Catalogue of Cell Lines & Hybidomas, American Type Culture Collection, 8th edition, 1995), or are produced using standard methods (Freshney, Culture of Immortalized Cells, Wiley-Liss, New York, 1996). Non-transformed cell lines are preferred for use in human subjects.

In one aspect, CD34+precursors that are differentiating under the influence of GM-CSF into dendritic cells are obtained from the body of a subject and nucleic acids encoding LAMP Constructs according to the invention are introduced into the cells, which are then injected into the subject. Utilizing the improved LAMP Constructs as described herein will enhance the association of peptides derived from a particular antigen with MHC class II molecules on the transduced antigen presenting cells, resulting in significantly more potent systemic T cell dependent immune responses and/or antibody production. While the antigen presenting cells transfected in this strategy are preferably autologous cells, any MHC class II cells that effectively present antigen in the host may be used as described above.

Peptide Vaccines

Also within the scope of this invention are peptide vaccines encoded by the improved LAMP Construct. Preferably, the allergen is processed within the compartment/organelle (or subsequent compartment/organelle to which it is delivered) to generate an epitope bound to an MHC class II molecule capable of modulating an immune response.

The peptide vaccines encoded by the improved LAMP Constructs may also be bound in a membranous structure to facilitate its administration to the body of an organism. For example, the peptide vaccine encoded by the improved LAMP Construct may be incorporated into liposomes, as described in U.S. Pat. No. 4,448,765.

When a protein or polypeptide is to be used as an immunogen, it may be produced by expression of any one or more of the improved LAMP Constructs described herein in a recombinant cell or it may be prepared by chemical synthesis. For example, the Merrifield technique (Journal of American Chemical Society, vol. 85, pp. 2149-2154, 1968), can be used.

Treatment of Allergies

This invention provides a formulation useful for the treatment of pollinosis correlated with Allergen X. It has previously been determined that delivering a DNA plasmid encoding the protein coding sequence of an allergen to an animal can increase IFN-gamma production and lower IL-4 production, which is useful in treating animals allergic to the specific allergen. The present invention provides improved LAMP Constructs for treating patients with an allergy correlated to Allergen X. The improved LAMP Constructs has a specific intracellular trafficking pattern that intersects with MHC class II vesicles, and results in enhanced presentation of Allergen X to the immune system, specifically resulting in an enhanced antibody response. Nucleic acids and compositions provided by the present invention are useful for conducting allergy immunotherapy.

The present invention provides a formulation that when administered to a cell results in an increased specific antibody response. The increased antibody response to Allergen X is useful for treating an IgE-mediated allergic disease. IgE has certain properties related to its cellular restriction and the resulting intracellular signaling upon binding cognate allergen. IgE is generated against an allergen when B cells receive IL-4 secreted by Th2 cells. This helps instruct B cells to produce IgE class antibodies. Upon secretion by B cells, IgE binds to Fc-εRI, its high affinity receptor expressed by mast cells and eosinophils, resulting in these cells and the animal becoming sensitized to future allergen exposure. Consequently, the symptoms of allergy can be triggered upon the ingestion, inhalation, or mucosal contact with an allergen. Due to the binding properties of antibodies, it has been proposed that one way of reducing allergy symptoms is to chelate free allergen available for binding by IgE through competition with other antibody classes. In particular, an allergy formulation that increases IgG has been proposed to be a pathway for reducing allergic disease. The invention described herein induces enhanced IgG production, thus causing a decrease in the ratio of IgE to IgG in a clinically significant manner.

In a particularly preferred embodiment, the invention provides a method of treatment or prevention of an allergy to Allergen X by using the improved LAMP Constructs as described herein. In one preferred method, improved LAMP Constructs comprising polynucleotides encoding Allergen X described herein targets the Allergen X allergen to an endosomal/lysosomal compartment or lysosome-related organelle and for association with an MHC class II molecule either within the compartment/organelle or within another compartment/organelle to which the antigen is delivered. Such chimeric DNA molecules can encode additional domain sequences as described above (e.g., sequences encoding transmembrane domains, signal sequences, cytoplasmic domains for targeting to an endosomal/lysosomal compartment or lysosome-related organelles, di-leucine domains, Tyr motif domains, proline rich domains, Ser-Val-Val domains, and the like).

Host Cells

In bacterial systems, a number of expression vectors may be advantageously selected depending upon the intended use. For example, when a large quantity of a protein is to be produced (e.g., to express the encoded polypeptides of the improved LAMP Construct), vectors which direct the expression of high levels of fusion protein products that are readily purified may be desirable. Such vectors include, but are not limited to, the *E. coli* expression vector pUR278 (Ruther et al., EMBO 1. 2:1791 (1983)), in which the coding sequence may be ligated individually into the vector in frame with the lac Z coding region so that a fusion protein is produced; pIN vectors (Inouye & Inouye, Nucleic Acids Res. 13:3101-3109 (1985); Van Heeke & Schuster, J. Biol. Chem. 24:5503-5509 (1989)); and the like. pGEX vectors may also be used to express foreign polypeptides as fusion proteins with glutathione 5-transferase (GST). In general, such fusion proteins are soluble and can easily be purified from lysed cells by adsorption and binding to matrix glutathione agarose beads followed by elution in the presence of free glutathione. The pGEX vectors are designed to include thrombin or Factor Xa protease cleavage sites so that the cloned target gene product can be released from the GST moiety.

In an insect system, *Autographa californica* nuclear polyhedrosis virus (AcNPV) may be used as a vector to express the encoded polypeptides of the improved LAMP Construct. The virus grows in *Spodoptera frugiperda* cells. Coding sequences may be cloned individually into non-essential regions (for example, the polyhedrin gene) of the virus and placed under control of an AcNPV promoter (for example, the polyhedrin promoter).

In mammalian host cells, a number of viral-based expression systems may be utilized express the encoded polypeptides of the improved LAMP Construct. In cases where an adenovirus is used as an expression vector, the coding sequence of interest may be ligated to an adenovirus transcription/translation control complex, e.g., the late promoter and tripartite leader sequence. This chimeric gene may then be inserted in the adenovirus genome by in vitro or in vivo recombination.

Insertion in anon-essential region of the viral genome (e.g., region E1 or E3) will result in a recombinant virus that is viable and capable of expressing the encoded polypeptides of the improved LAMP Construct in infected hosts (e.g., see Logan & Shenk, Proc. Natl. Acad. Sci. USA 8 1:355-359 (1984)).

Specific initiation signals may also be required for efficient translation of inserted coding sequences. These signals include the ATG initiation codon and adjacent sequences. Furthermore, the initiation codon must be in phase with the reading frame of the desired coding sequence to ensure translation of the entire insert. These exogenous translational control signals and initiation codons can be of a variety of origins, both natural and synthetic. The efficiency of expression may be enhanced by the inclusion of appropriate transcription enhancer elements, transcription terminators, etc. (see, e.g., Bittner et al., Methods in Enzymol. 153:51-544 (1987)).

In addition, a host cell strain may be chosen which modulates the expression of the inserted sequences, or modifies and processes the gene product in the specific fashion desired. Such modifications (e.g., glycosylation) and processing (e.g., cleavage) of protein products may be important for the function of the protein. Different host cells have characteristic and specific mechanisms for the post-translational processing and modification of proteins and gene products. Appropriate cell lines or host systems can be chosen to ensure the correct modification and processing of the foreign protein expressed, to this end, eukaryotic host cells which possess the cellular machinery for proper processing of the primary transcript, glycosylation, and phosphorylation of the gene product may be used. Such mammalian host cells include, but are not limited to, CHO, VERY, BHK, Hela, COS, NSO, MDCK, 293, 3T3, and W138.

For long-term, high-yield production of recombinant proteins, stable expression is preferred. For example, cell lines which stably express the express the encoded polypeptides of the improved LAMP Construct may be engineered. Rather than using expression vectors which contain viral origins of replication, host cells can be transformed with a polynucleotide controlled by appropriate expression control elements (e.g., promoter, enhancer, sequences, transcription terminators, polyadenylation sites, etc.), and a selectable marker. Following the introduction of the foreign polynucleotide, engineered cells may be allowed to grow for 1-2 days in an enriched media, and then are switched to a selective media. The selectable marker in the recombinant plasmid confers resistance to the selection and allows cells to stably integrate the plasmid into their chromosomes and grow to form foci which in turn can be cloned and expanded into cell lines. This method may advantageously be used to engineer cell lines which express the encoded polypeptides of the improved LAMP Construct.

A number of selection systems may be used, including but not limited to, the herpes simplex virus thymidine kinase (Wigler et al., Cell 11:223 (1977)), hypoxanthineguanine phosphoribosyltransferase (Szybalska & Szybalski, Proc. Natl. Acad. Sci. USA 48:202 (1992)), and adenine phosphoribosyltransferase (Lowy et al., Cell 22:8 17 (1980)) genes can be employed in tk-, hgprt- or aprt-cells, respectively. Also, antimetabolite resistance can be used as the basis of selection for the following genes: dhfr, which confers resistance to methotrexate (Wigler et al., Natl. Acad. Sci. USA 77:357 (1980); O'Hare et al., Proc. Natl. Acad. Sci. USA 78:1527 (1981)); gpt, which confers resistance to mycophenolic acid (Mulligan & Berg, Proc. Natl. Acad. Sci. USA 78:2072 (1981)); neo, which confers resistance to the aminoglycoside G-418 (Goldspiel et al., Clinical Pharmacy, 12: 488-505 (1993); Wu and Wu, Biotherapy 3:87-95 (1991); Tolstoshev, Ann. Rev. Pharmacol. Toxicol. 32:573-596 (1993); Mulligan, Science 260:926-932 (1993); and Morgan and Anderson, Ann. Rev. Biochem. 62: 191-217 (1993); TIB TECH 11(5):155-2 15 (May; 1993)); and hygro, which confers resistance to hygromycin (Santerre et al., Gene 30:147 (1984)). Methods commonly known in the art of recombinant DNA technology may be routinely applied to select the desired recombinant clone, and such methods are described, for example; in Ausubel et al. (eds.), Current Protocols in Molecular Biology, John Wiley & Sons, NY (1993); Kriegler, Gene Transfer and Expression, A Laboratory Manual, Stockton Press, NY (1990); and in Chapters 12 and 13, Dracopoli et al. (eds), Current Protocols in Human Genetics, John Wiley & Sons, NY (1994); Colberre-Garapin et al., J. Mol. Biol. 150:1 (1981).

The expression levels of the encoded polypeptides of the improved LAMP Construct can be increased by vector amplification (for a review, see Bebbington and Hentschel, *The Use Of Vectors Based On Gene Amphification For The Expression Of Cloned Genes In Mammalian Cells In DNA Cloning*, Vol. 3. (Academic Press, New York, 1987)). When a marker in the vector system expressing the encoded polypeptides of the improved LAMP Construct is amplifiable, an increase in the level of inhibitor present in the host cell culture will increase the number of copies of the marker gene. Since the amplified region is associated with the coding sequence, production of the encoded polypeptides of the improved LAMP Construct will also increase (Crouse et al., Mol. Cell. Biol. 3:257 (1983)).

Other elements that can be included in vector sequences include heterologous signal peptides (secretion signals), membrane anchoring sequences, introns, alternative splice sites, translation start and stop signals, inteins, biotinylation sites and other sites promoting post-translational modifications, purification tags, sequences encoding fusions to other proteins or peptides, separate coding regions separated by internal ribosome reentry sites, sequences encoding "marker" proteins that, for example, confer selectability (e.g., antibiotic resistance) or sortability (e.g., fluorescence), modified nucleotides, and other known polynucleotide cis-acting features not limited to these examples.

Once the encoded polypeptides of the improved LAMP Construct has been produced by recombinant expression, it may be purified by any method known in the art for purification of a protein, for example, by chromatography (e.g., ion exchange, affinity (particularly by Protein A affinity and immunoaffinity for the specific allergen), and sizing column chromatography), centrifugation, differential solubility, or by any other standard technique for the purification of proteins. Further, the encoded polypeptides of the improved LAMP Construct may be fused to heterologous polypeptide sequences described herein or otherwise known in the art to facilitate purification.

Administration

Vaccine material according to this invention may contain the immune stimulatory improved LAMP Constructs described herein or may be recombinant microorganisms, or antigen presenting cells which express the immune stimulatory improved LAMP Constructs. Preparation of improved LAMP Constructs containing vaccine material according to this invention and administration of such improved LAMP Constructs for immunization of individuals are accomplished according to principles of immunization that are well known to those skilled in the art.

Large quantities of these materials may be obtained by culturing recombinant or transformed cells containing replicons that express the improved LAMP Constructs described herein. Culturing methods are well-known to those skilled in the art and are taught in one or more of the documents cited above. The improved LAMP Construct vaccines are generally produced by culture of recombinant or transformed cells and formulated in a pharmacologically acceptable solution or suspension, which is usually a physiologically-compatible aqueous solution, or in coated tablets, tablets, capsules, suppositories or ampules, as described in the art, for example in U.S. Pat. No. 4,446,128, incorporated herein by reference. Administration may be any suitable route, including oral, rectal, intranasal or by injection where injection may be, for example, transdermal, subcutaneous, intramuscular or intravenous.

The improved LAMP Constructs are administered to a mammal in an amount sufficient to induce an immune response in the mammal. A minimum preferred amount for administration is the amount required to elicit antibody formation to a concentration at least 4 times that which existed prior to administration. A typical initial dose for administration would be 10-5000 micrograms when administered intravenously, intramuscularly or subcutaneously, or $10^5$ to $10^{11}$ plaque forming units of a recombinant vector, although this amount may be adjusted by a clinician doing the administration as commonly occurs in the administration of vaccines and other agents which induce immune responses. A single administration may usually be sufficient to induce immunity, but multiple administrations may be carried out to assure or boost the response.

The improved LAMP Construct vaccines maybe tested initially in a non-human mammal (e.g., a mouse or primate). For example, assays of the immune responses of inoculated mice can be used to demonstrate greater antibody, T cell proliferation, and cytotoxic T cell responses to the improved LAMP Constructs than to wild type allergen. Improved LAMP Constructs can be evaluated in Rhesus monkeys to determine whether the vaccine formulation that is highly effective in mice will also elicit an appropriate monkey immune response. In one aspect, each monkey receives a total of 5 mg DNA per immunization, delivered IM and divided between 2 sites, with immunizations at day 0 and at weeks 4, 8, and 20, with additional doses optional. Antibody responses, ADCC, CD4+ and CD8+ T-cell cytokine production, CD4+ and CD8+ T-cell antigen-specific cytokine staining can be measured to monitor immune responses to the vaccine.

Further description of suitable methods of formulation and administration according to this invention may be found in U.S. Pat. No. 4,454,116 (constructs), U.S. Pat. No. 4,681,762 (recombinant bacteria), and U.S. Pat. Nos. 4,592,002 and 4,920,209 (recombinant viruses).

Kits

The invention further comprises kits to facilitate performing the methods described herein. In one aspect, a kit comprises an improved LAMP Construct as described herein and a cell for receiving the improved LAMP Construct. The kit may additionally comprise one or more nucleic acids for engineering the cell into a professional APC. In one aspect, however, the cell is a professional APC. The cell may or may not express co-stimulatory molecules. In a preferred aspect, when the cell does not express co-stimulatory molecules, the allergen encoded by the improved LAMP Construct is an autoantigen. In another aspect, a panel of cells is provided expressing different MHC molecules (e.g., known to be expressed in human beings). In a further aspect, the kit comprises reagents to facilitate entry of the improved LAMP Constructs into a cell (e.g., lipid-based formulations, viral packaging materials, cells, and the like). In still a further aspect, one or more T cell lines specific for the allergen encoded by the improved LAMP Construct is provided, to verify the ability of the improved LAMP Construct to elicit, modulate, or enhance an immune response.

EXAMPLES

The invention will now be further illustrated with reference to the following examples. It will be appreciated that what follows is by way of example only and that modifications to detail may be made while still falling within the scope of the invention.

Example 1—Construction of LAMP Constructs

The improved LAMP Constructs illustrated in FIG. 1 can be constructed using standard molecular biology techniques well known to the skilled artisan. For example, plasmids comprising the polynucleotides can be designed to generate the different structures ILC-1 to ILC-6 shown in FIG. 1. The LAMP domains illustrated in FIG. 1 can be derived from the amino acid sequences shown in FIGS. 3-10. Preferably the LAMP domains are derived from the human LAMP proteins shown in FIGS. 3-10. The boundaries of each domain can be derived from FIG. 2A and FIG. 2B. It is envisioned that the corresponding domains can also be cloned from the orthologous sequences by identifying the equivalent domains when compared to the human sequence. The Allergen X (SEQ ID NO:Y) can be cloned into the described LAMP Constructs either individually or in combination as described in Table 1/FIG. 14.

Example 2—Immune Response Evaluation of Mice to LAMP Constructs

The ability of the improved LAMP Constructs as described in Example 1 can be tested for their ability to modulate an immune response. For example, Female BALB/c mice can be immunized i.d with 50 ug of the improved LAMP Constructs in 100 ul PBS using nanopass on day 0, 7, and 14. Experiment will then be terminated 2 weeks after the last dose.

Splenocytes ($3\times10^5$/well) are stimulated with allergenic protein (10 ug/ml) in T cell media (RPMI with 10% heat inactivated FBS, 1% penicillin/streptomycin, and 1×2-ME), supernatants are collected 48 h after. Supernatants are diluted (400 ul supernatant+200 ul T cell media) and cytokines are evaluated by ELISA. IL-10 or IL-4 production can be measured via ELISPOT assay.

Alternatively, serum samples can be diluted 1:100 (day 21), 1:2000 (day 35) or 1:5000 (day 56) fold in 1% BSA in PBS. Day 56 samples are further diluted by a 7 point 1:3 serial dilution to measure the endpoint antibody titers. To detect IgE, sera can be treated with Agarose-Protein G (Thermo Fisher Scientific, Rockford, IL) 50 minutes and then 1:20 diluted samples are loaded to ELISA plates. Samples are detected with goat anti-mouse IgG1-HRP, goat anti-mouse IgG2a-HRP (Southern Biotech, Birmingham, Al), or rat anti-mouse-IgE-biotin (R35-118, BD Pharmingen, San Jose, CA) followed Pierce Streptavidin-HRP (Thermo Fisher Scientific, Rockford, IL). Reaction is developed with SureBlue TMB Substrate and stopped with TMB Stop Solution. Plates are read (OD450) by using Epoch ELISA reader (BioTek, Winooski, VT). Endpointtiters are determined by subtracting twice above the of background average (PBS) reading. The means and standard errors of endpoint titers or OD450 values per group are analyzed by using Excel statistic function. IgE data is analyzed by using Student T test. Tests are two tailed, and p values<0.05 were considered significant. After three doses of vaccination, antigen-specific IgG1 and IgG2a antibodies are expected to be observed in the recipient mice. It is believed that IgG2a levels will be much higher than expected due to the predicted Th2 to Th1 skewing of the immune response.

Example 3—Prime/Boost Protocol

Herpesvirus entry mediator (HVEM), also known as tumor necrosis factor receptor superfamily member 14 (TNFRSF14) or CD270, is a human cell surface receptor of the TNF-receptor superfamily. In recent years, HVEM has been found highly expressed on hematopoietic cells and a variety of parenchymal cells, such as breast, melanoma, colorectal, and ovarian cancer cells, as well as gut epithelium. HVEM is a bidirectional protein, either inhibiting or stimulating T cells, through binding to BTLA or LIGHT (TNFSF14).

We generated a DNA vaccine encoding HVEM-LAMP to generate an antibody which could block the inhibitory function of HVEM for tumor therapeutic applications. We hypothesized that LAMP will promote the antibody response by enhancing the affinity of HVEM specific antibodies and/or expanding the repertoire of B cell epitopes in the HVEM protein. In this study, we compared the immunogenicity of HVEM encoding plasmid with and without LAMP (SEQ ID NO: 158 and SEQ ID NO:159). Plasmids encoding HVEM-LAMP and HVEM and recombinant HVEM protein were designed as described herein.

Goat anti-mouse IgG-HRP was purchased from Southern Biotechnologies (Birmingham, AL). SureBlue TMB microwell peroxidase substrate and TMB stop solution were purchased from KPL (Gaithersburg, MD). ELISPOT plates were ordered from EMD Millipore (Billerica, MA, Cat. No. MAIPS4510). IFN-γ antibody pair used in ELISPOT was purchased from BioLegend (San Diego, CA) and clones AN18 and R46A2 were used as coating and detection, respectively. Streptavidin-HRP and AEC substrate were purchased from BD Biosciences (San Jose, CA).

Six to eight week old female Balb/c mice were purchased from Harlan Laboratories (Frederick, MA) and maintained at animal facility in Immunomic Therapeutics, Inc. (Rockville, MA). Mice (n=6) were treated with 10 µg/dose of HVEM-LAMP, HVEM, or LAMP vector control by electroporation IM delivery at days 0, 7, and 14. On day 35, mice were boosted with 5 µg HVEM protein in the presence of Alum by i.p. injection. On day 28 and 49, mice were bled and sera were isolated for antibody detection. Mice were sacrificed on day 56 and splenocytes were tested for IFN-γ production by ELISPOT.

ELISA procedure was followed by Su et al., J of Immunol Res; (10):1-15 (2016). Plates were coated with 5 µg/ml HVEM protein. Data were analyzed by using Microsoft Excel and Prism 6 software.

Figure 12:
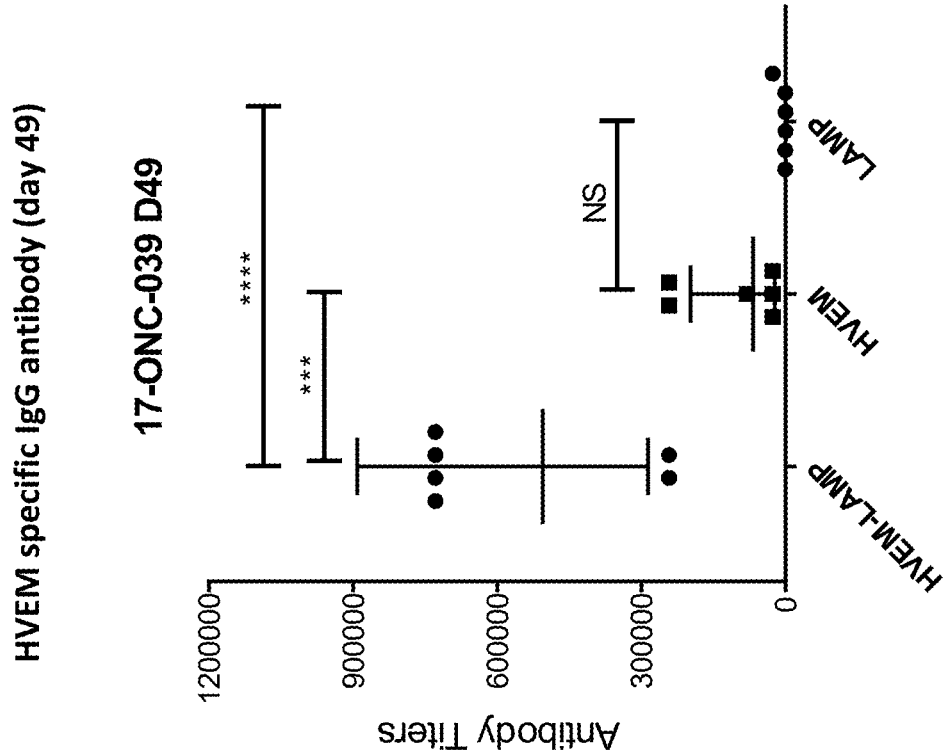
Figure 11:
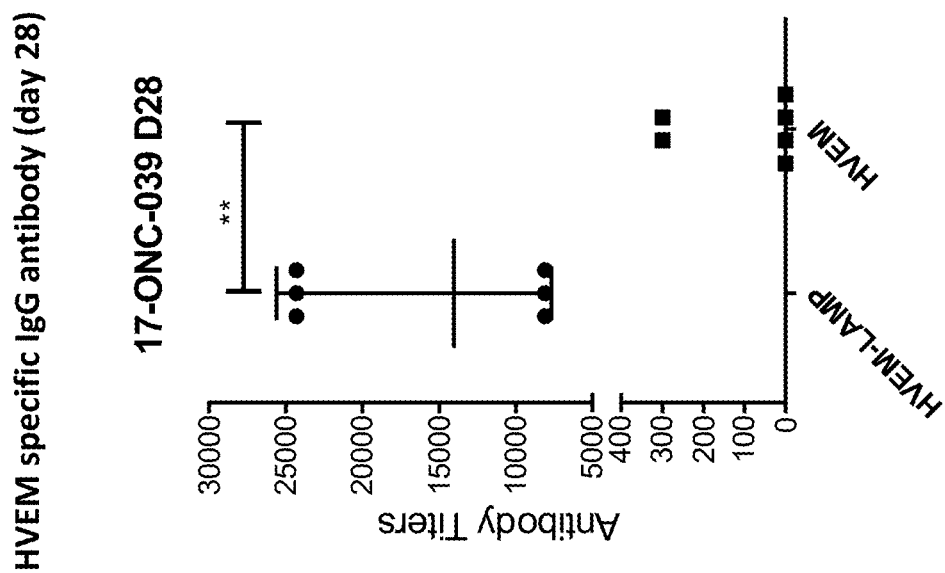

The primary aim of this study was to compare the antibody profiles between HVEM-LAMP and HVEM. On day 28, HVEM-LAMP vaccinated mice produced significant higher level of HVEM specific IgG antibody than that of the HVEM group (FIG. 11). After a protein boost, the HVEM specific antibody was increased about 1000-fold in HVEM immunized mice and the mean titer was changed from 100 to 108000. This result indicates that the immune memory was induced by the HVEM DNA plasmid. Although HVEM DNA alone only induced a minimal antibody response, protein boost rapidly recalled the immune memory. On the other hand, HVEM-LAMP group again exhibited a significant higher titer than the HVEM and LAMP groups, the mean titer is 5 folds of the HVEM group, indicating the power of LAMP in enhancing antibody response (FIG. 12).

Figure 13:
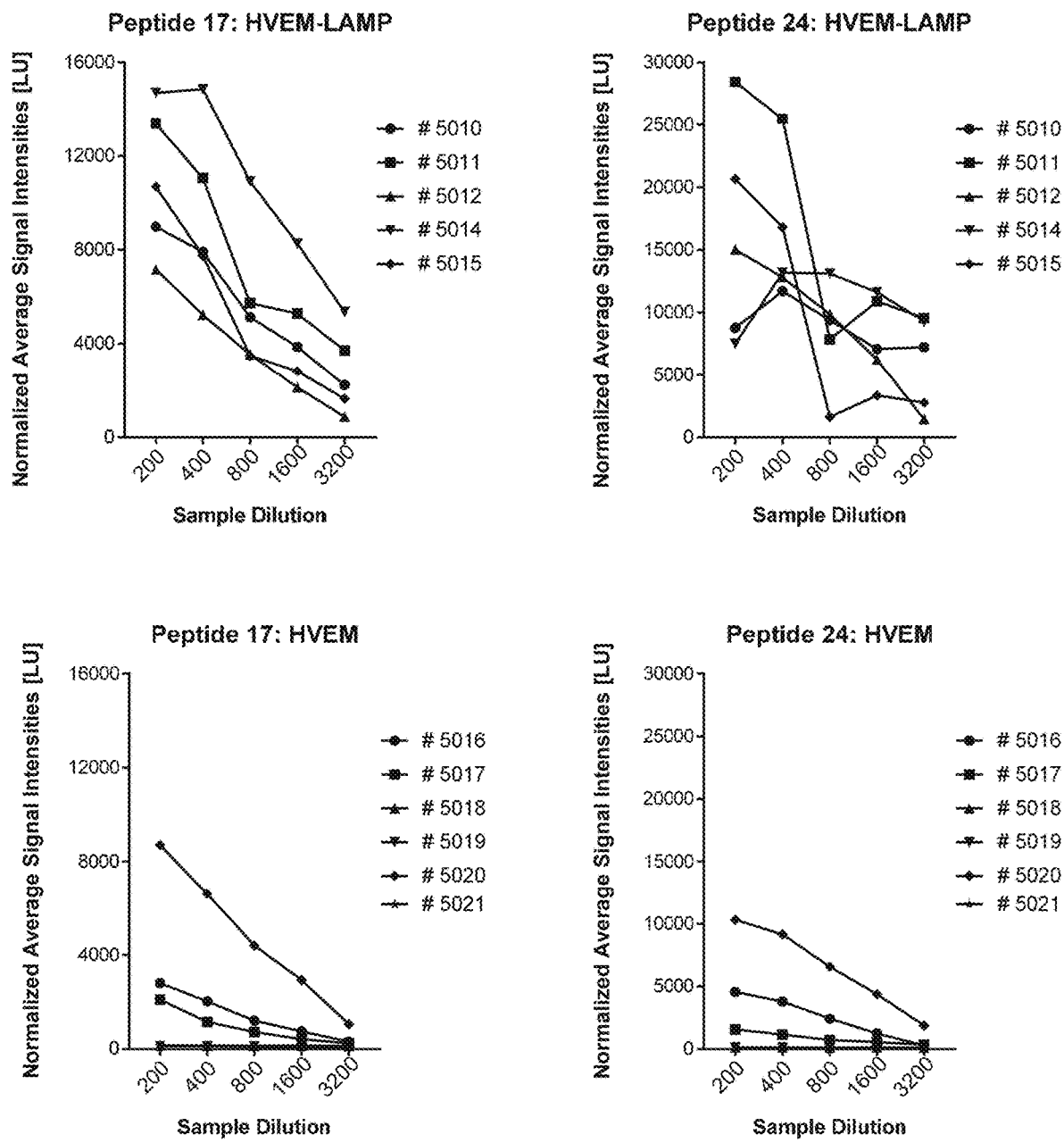
Figure 13:
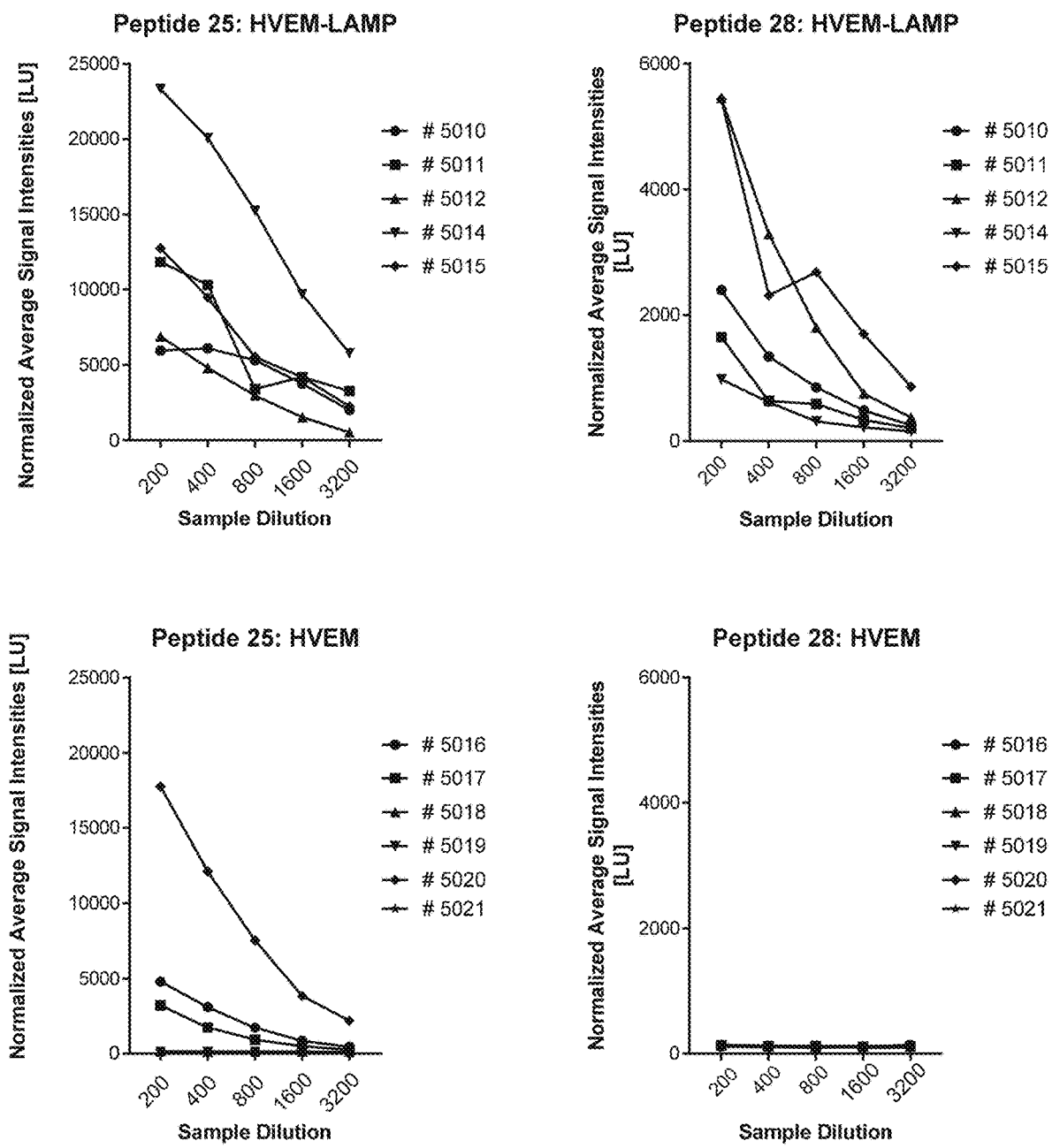

Additionally, serum samples (Day 49) from HVEM+LAMP or HVEM alone immunized/HVEM protein boosted mice were pooled and tested for peptide mapping. Twelve peptides were found to be bound to the pooled serum (mouse IgG reaction) and seven of the twelve peptides showed strong binding affinity. HVEM+LAMP alters the binding affinity of peptides 17. 24, 25, and 28 as compared to HVEM alone as shown in FIG. 13. These changes may have physiological effects in protecting tumor growth.

This example illustrates the ability to use a prime-boost protocol with the improved LAMP constructs described herein along with the described allergens.

Example 4—Testing of Amb a 1-hLAMP

Ragweed, a major allergy risk factor, is one of the most important pollen allergens in North America and parts of Europe. Epidemiological studies showed that 23% to 32.8% of the US population is sensitized to ragweed, whereas prevalence of sensitization in European countries varies between 3.5% (eg, Italy) and 54% (eg, Hungary). Amb a 1, the most abundant allergen in ragweed pollen, is composed of a mixture of five isoforms with amino acid sequence identities ranging between 63% and 87%. The clinical relevance of Amb a 1 has been documented in numerous publications. DNA vaccination has great potential as an effective prophylactic and therapeutic solution to ragweed pollen allergy. We have previously integrated the advantages of the DNA vaccine technique with the MHC II pathway targeting property of LAMP-1 and designed a novel DNA vaccine against ragweed allergy.

Here, we optimized our LAMP platform by replacing the hinge region of LAMP (ILC-4). This study aims to compare the in vivo immunogenicity of different version of Amb a 1-LAMP vaccines using the sequence of SEQ ID NO: 137 as the allergen. Control vector, Amb a 1-hLAMP (complete LAMP), Amb a1-hLAMP preluminal (ILC-1), Amb a1-hLAMP Hinge (ILC-4), and Amb a 1 protein were made by NTC (Lincoln, NE). Goat anti-mouse IgG2a-HRP and goat anti-mouse IgG1-HRP were purchased from Southern Biotechnologies (Birmingham, AL). SureBlue TMB microwell peroxidase substrate and TMB stop solution were purchased from KPL (Gaithersburg, MD). Mouse monoclonal anti-hLAMP was purchased from Origene Technologies (Rockville, MD). Rabbit monoclonal anti-GAPDH antibody was bought from Abcam (Cambridge, MA). Goat-anti-mouse and goat anti-rabbit secondary antibody were obtained from Sino Biological (Wayne, PA)

Vaccines, adjuvants and immunizations. 40 μg of Control vector, complete LAMP, ILC-1, and ILC-4 were used in a total volume of 20 μl per mouse per dose for intradermal/electroporation injection. Mice were immunized with the vaccine by i.d. delivery on days 0, 7, and 14. Mice were bled on days 28 and day 40 for serum collection. Serum was collected and stored in −30° C.

Western Blot. 293T cells were transfected with the plasmids using lipofectamine 2000 reagents (Invitrogen). Transfected cells were washed with PBS and suspended in 200 μl of RIPA lysis buffer with halt proteinase inhibitors (Thermo Scientific, Waltham, MA). Lysates were centrifuges (700 g for 15 minutes at 4° C.), followed by measurement of protein concentration in the clarified supernatants using Pierce BCA protein Assay kit (ThermoFisher Scientific, Waltham, MA). 5 μg of protein was electrophoresed in pre-cast (4-20%) SDS-PAGE gels (BioRad, Hercules, California), and transferred onto nitrocellulose membranes (BioRad).

Membranes were blocked with Detection™ block buffer (KPL) and probed anti-human LAMP (FIG. 15A) or anti-GAPDH and goat anti-mouse-HRP or goat anti-rabbit antibody (FIG. 15B), followed by developing with TMB (KPL).

Measurement of serum Amb a 1-specific IgG1 and IgG2a by ELISA. As shown in FIG. 16, the murine antibody response to Amb a 1 was assessed by indirect ELISA. ELISA plates (MaxiSorp) were coated with 5 μg/ml Amb a 1 in PBS buffer overnight and then blocked with 2% BSA in PBS. Plasma samples were diluted 1:300 or 1:1000 in blocking buffer. Samples were detected with goat anti-mouse IgG1-HRP or IgG2a-HRP. Reaction was developed with SureBlue TMB Substrate and stopped with TMB Stop Solution from KPL (Gaithersburg, MD). Plates were read (OD450) by using Epoch ELISA reader (BioTek, Winooski, VT).

Statistics. Two-Way ANOVA test was performed using GraphPad Prism 6.0 software to evaluate the statistical significance. Data represent mean of antibody titers±SEM (n=9). Two-way ANOVA was used for statistical analysis. * p<0.05;  p<0.01, * p<0.001 **** p<0.0001.

Results. In this study, we tested different constructs of Amb a 1-LAMP vaccines. After 3 dose of DNA vaccines (one week apart), we found ILC-1 and ILC-4 induced unexpectedly higher Amb a 1 specific IgG2a response at day 40 than the complete-LAMP Amb a 1 vaccine.

Example 5—Testing of Bet v 1-hLAMP

Bet v 1, the major birch pollen allergen, is considered the prototype for the PR-10 protein family causing respiratory allergy. The greatest majority of birch allergy patients (over >90%) react to Bet v 1, and as a consequence is used as a marker for birch pollen allergy. DNA vaccination has great potential as an effective prophylactic and therapeutic solution to birch pollen allergy in early spring.

Figure 15A:
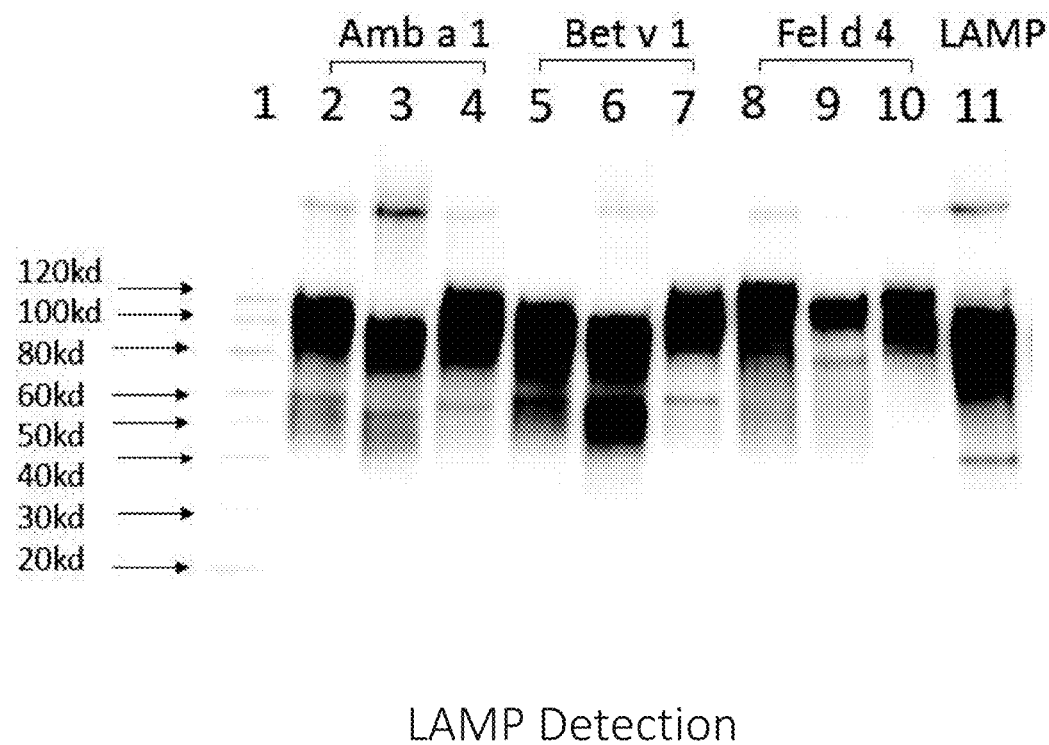
Figure 15B:
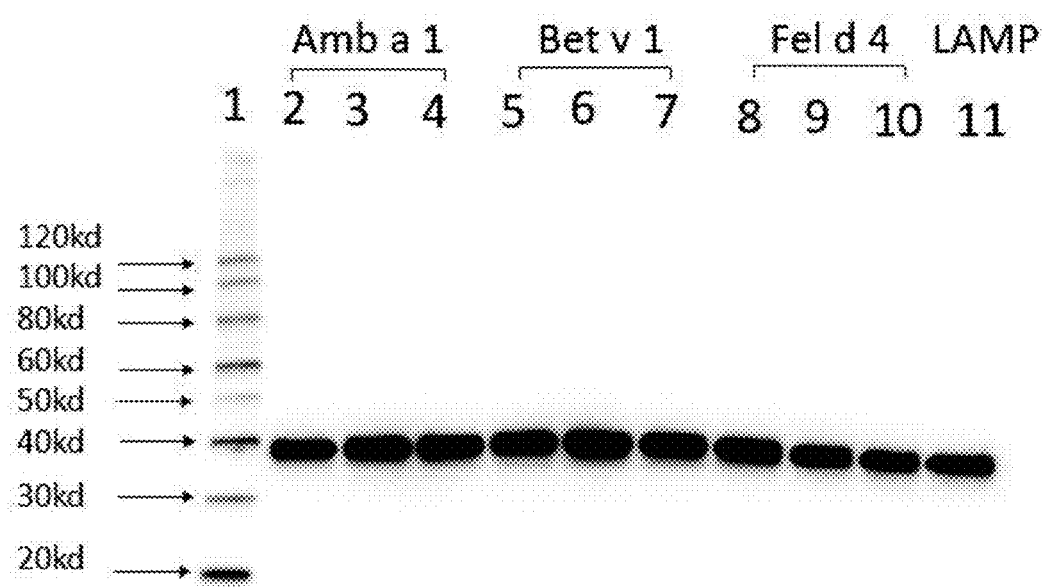

Here, we tested protein expressed from control vector Bet v 1-hLAMP (complete LAMP), Bet v 1-hLAMP preluminal (ILC-1), Bet v 1-hLAMP Hinge (ILC-4), and Bet v 1 protein as described in Example 4. In this Example, the sequence of SEQ ID NO: 141 is the allergen. FIG. 15A and FIG. 15B demonstrate expression. As shown in FIG. 17, after 3 dose of DNA vaccines (one week apart), we found ILC-4 induced unexpectedly significantly stronger Bet v 1 specific IgG2a response at day 28 and day 41 than the complete-LAMP Bet v 1 and ILC-1 vaccine, suggesting this new version of Bet v 1-LAMP construct is very immunogenic.

Example 6—Testing of Fel d 4-hLAMP

Cats are popular household pets and commonly cause allergies. Cat allergy is unique among allergy to mammals in that the major allergen Fel d 1 is a uteroglobin-like protein and not a lipocalin. However, Fel d 4, which has been identified as a lipocalin allergen produced by the cat, binds IgE at relatively high frequency in cat-sensitive individuals. The biochemical spectrum of the cat allergens is thus uncertain, particularly with regard to the role that a cat lipocalin protein may play in sensitization to cats in allergic individuals. Recently, Fel d 1- and Fel d 4-specific IgE was assessed in patients with pet allergy. Of those with cat allergy, 94% had increased levels (>0.35 kU/L) of Fel d 1, and 49% had increased levels of Fel d 4.

Here, we tested protein expressed from control vector Fel d 4-hLAMP (complete LAMP), Fel d 4-hLAMP preluminal (ILC-1), Fel d 4-hLAMP Hinge (ILC-4), and Fel d 4 protein as described in Example 4.

FIG. 15A and FIG. 15B demonstrate expression. In this Example, the sequence of SEQ ID NO:182 is the allergen. As shown in FIG. 18, after 3 dose of DNA vaccines (one week apart), we found ILC-1 induced slightly higher Fel d 4 specific IgG2a response at day 28 and day 41 than the other groups. However, there is no statistical difference between ILC-1 and ILC-4.

Example 7—Testing of Cry J 1

The Japanese red cedar tree is a cultural symbol in Japan, but its pollen is a national scourge. An estimated 25% of the Japanese population, more than 25 million individuals, are allergic to Japanese red cedar pollen.

Figure 15C:
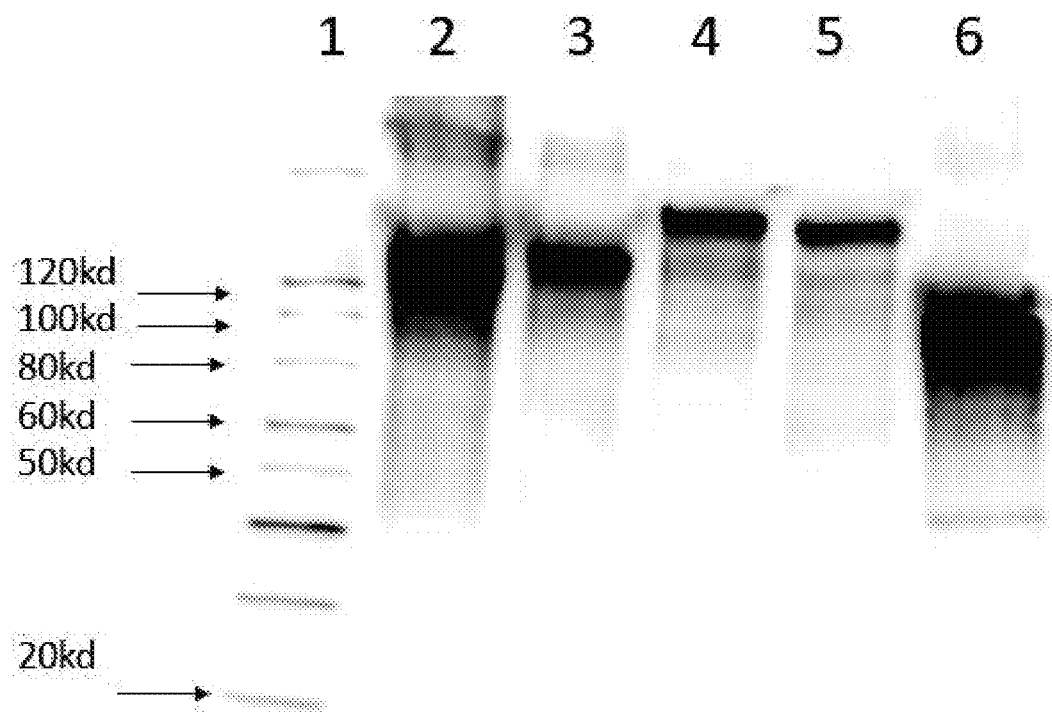

We tested Cry J1 and Cry J2 specific antibody responses by ELISA. FIG. 15C. In this Example, the sequence of SEQ ID NO:224 is the allergen. Female BALB/c mice were immunized ID with 40 μg of control vector, CryJ1+CryJ2+Complete LAMP, or Cry J1+J2+ILC-4 DNA in 20 ul PBS via the ear on day 0, 7, and 14. The study was terminated 26 days after the last dose. Serum samples were collected at day 28 and day 40. Cry J1 and Cry J2 specific IgG1 and IgG2a were measured by indirect ELISA. Data represent mean of antibody titers±SEM. N=6 per group. Two way ANOVA was used for statistical analysis. *p<0.05,** p<0.01.

The complete and ILC-4 single Cry J1+J2+LAMP constructs were compared. Cry J1 and Cry J2 specific IgG1 and IgG2a responses are summarized in FIG. 19. Although the ILC-4 construct showed a trend of higher titers with Cry J1, these were not statistically significant. In the Cry J2 specific response, however, the titers were statically higher than the Complete LAMP construct.

In conclusion, data from this study suggest that two constructs were expressed in vivo and LAMP significantly improved the humoral immune response.

Variations, modifications, and other implementations of what is described herein will occur to those of ordinary skill in the art without departing from the spirit and scope of the invention and the claims. All of the patents, patent applications, international applications, and references identified are expressly incorporated herein by reference in their entireties.

SEQUENCE LISTING (252 sequences)

SEQ ID NO: 1 - protein, 417 aa, Homo sapiens
MAAPGSARRPLLLLLLLLLLGLMHCASAAMFMVKNGNGTACIMANFSAAFSVNYDTKSGPKNMTFDLPSDATVVLNRSSCGKENTSDPSLVIAFGRGHTLTLNFTRNATRYSVQLMSFVYNLSDTHLFPNASSKEIKTVESITDIRADIDKKYRCVSGTQVHMNNVTVTLHDATIQAYLSNSSFSRGETRCEQDRPSPTTAPPAPPSPSPSPVPKSPSVDKYNVSGTNGTCLLASMGLQLNLTYERKDNTTVTRLLNINPNKTSASGSCGAHLVTLELHSEGTTVLLFQFGMNASSSRFFLQGIQLNTILPDARDPAFKAANGSLRALQATVGNSYKCNAEEHVRVTKAFSVNIFKVWVQAFKVEGGQFGSVEECLLDENSMLIPIAVGGALAGLVLIVLIAYLVGRKRSHAGYQTI

SEQ ID NO: 2 - protein, 410 aa, Homo sapiens
MVCFRLFPVPGSGLVLVCLVLGAVRSYALELNLTDSENATCLYAKWQMNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNEFLCDKDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVKNENRFYLKEVNISMYLVNGSVFSIANNNLSYWDAPLGSSYMCNKEQTVSVSGAFQINTFDLRVQPFNVTQGKYSTAQDCSADDDNFLVPIAVGAALAGVLILVLLAYFIGLKHHHAGYEQF

SEQ ID NO: 3 - protein, 416 aa, Homo sapiens
MPRQLSAAAALFASLAVILHDGSQMRAKAFPETRDYSQPTAAATVQDIKKPVQQPAKQAPHQTLAARFMDGHITFQTAATVKIPTTTPATTKNTATTSPITYTLVTTQATPNNSHTAPPVTEVTVGPSLAPYSLPPTITPPAHTTGTSSSTVSHTTGNTTQPSNQTTLPATLSIALHKSTTGQKPVQPTHAPGTTAAAHNTTRTAAPASTVPGPTLAPQPSSVKTGIYQVLNGSRLCIKAEMGIQLIVQDKESVFSPRRYFNIDPNATQASGNCGTRKSNLLLNFQGGFVNLTFTKDEESYYISEVGAYLTVSDPETIYQGIKHAVVMFQTAVGHSFKCVSEQSLQLSAHLQVKTTDVQLQAFDFEDDHFGNVDECSSDYTIVLPVIGAIVVGLCLMGMGVYKIRLRCQSSGYQRI

SEQ ID NO: 4 - protein, 478 aa, Homo sapiens
MGRCCFYTAGTLSLLLLVTSVTLLVARVFQKAVDQSIEKKIVLRNGTEAFDSWEKPPLPVYTQFYFFNVTNPEEILRGETPRVEEVGPYTYRELRNKANIQFGDNGTTISAVSNKAYVFERDQSVGDPKIDLIRTLNIPVLTVIEWSQVHFLREIIEAMLKAYQQKLFVTHTVDELLWGYKDEILSLIHVFRPDISPYFGLFYEKNGTNDGDYVFLTGEDSYLNFTKIVEWNGKTSLDWWITDKCNMINGTDGDSFHPLITKDEVLYVFPSDFCRSVYITFSDYESVQGLPAFRYKVPAEILANTSDNAGFCIPEGNCLGSGVLNVSICKNGAPIIMSFPHFYQADERFVSAIEGMHPNQEDHETFVDINPLTGIILKAAKRFQINIYVKKLDDFVETGDIRTMVFPVMYLNESVHIDKETASRLKSMINTTLIITNIPYIIMALGVFFGLVFTWLACKGQGSMDEGTADERAPLIRT

SEQ ID NO: 5 - protein, 197 aa, Homo sapiens
MSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSVSTATPVPTANSTAKPTVQPSPSTTSKTVTTSGTTNNTVTPTSQPVRKSTFDAASFIGGIVLVLGVQAVIFFLYKFCKSKERNYHTL

SEQ ID NO: 6 - protein, 406 aa, Mus musculus
MAAPGARRPLLLLLLAGLAHGASALFEVKNNGTTCIMASFSASFLTTYETANGSQIVNISLPASAEVLKNGSSCGKENVSDPSLTITFGRGYLLTLNFTKNTTRYSVQHMYFTYNLSDTEHFPNAISKEIYTMDSTTDIKADINKAYRCVSDIRVYMKNVTVVLRDATIQAYLSSGNFSKEETHCTQDGPSPTTGPPSPSPPLVPTNPTVSKYNVTGNNGTCLLASMALQLNITYLKKDNKTVTRAFNISPNDTSSGSCGINLVTLKVENKNRALELQFGMNASSSLFFLQGVRLNMTLPDALVPTFSISNHSLKALQATVGNSYKCNTEEHIFVSKMLSLNVFSVQVQAFKVDSDRFGSVEECVQDGNNMLIPIAVGGALAGLVLIVLIAYLIGRKRSHAGYQTI

SEQ ID NO: 7 - protein, 411 aa, Danio rerio
MARAAGVCWTLLMGCVFAAHAVTFEVTDGNSTCIKGELNASFSISYNTTNGTSVSVFALPASASVSERSSCGSAAVPPELALVFGDTHTHTLSLLFSRDQRLYRVSNISLQYNLSDGDIFPQSSSAGVQSVMASVSELMSARLNSTYRCVSSSSISLSAAVNLTLSGVQMEAYMSSANLSADESVCSADQPSTTVAPPPSTTTSPPPIPPVPERGNYSVTDGNGTVCVLALMGLQLNITHTTTQNQSVSELMNLQPNQTTVSGSCGVTESSLRLSDETTNLTFSFTMNSTTQKYYLSAVSVSALWPDMSVVFEAGNTSLSALQCSVGRSYVCSAQQMLSVTPVFSINTFRLQLQPFNITANRFSTAEECRVDQENMLIPIIVGAALAGLVLIVLVAYLIGRKRTHAGYQTI

SEQ ID NO: 8 - protein, 417 aa, Xenopus laevis
MSWRQVKMPVYWMAVMLLIGVVQVATAVQFEVKDGKTNITCILADLSINFSVSYNVSSKMELATFVLPSEAVTNINKSSCGVENTTAPVLAIQFGSNHSLSIHFARNNTRYEVAELVMSYNLSDKIIFPNASENGTKTVSTNKTAVLAENDTVYKCMNPHLIRMDNANATFHDIRLEAYLKQSNFSQKVSTCSEDITPTSAPAPVTTTAPVPAPVPDPPVVQYSVNRSSEPCLLAKVGLQMNITYTTKDGKNGSYVFNIESKGVTVDGNCTNTTAYLSLSTGSIDLRFNFTLNSSLEVFYLDGVSLSTGLPADANDTHFEAANSSLNYMQTNVHKSFKCNSKQTLQITDPFTVNTYHLQVQAFNSDNTFASAVECSLDENGMLVPIVVGAALAGLVLIVLIAYLIGRKRSHAGYQTI

SEQ ID NO: 9 - protein, 417 aa, Pan troglodytes
MAAPGSARRPLLLLLLLLLLGLVHCASAAMFMVKNGNGTACIMANFSASFSVNYDTKSGPKNMTFDLPSDATVVLNRSSCGKENTSDPSLVIAFGRGHTLTLNFTRNATRYSVQLMSFVYNLSDTHLFPNASSKEIKTVESITDIRADIDKKYRCVSGTQVHMNNVTVTLHDATIQAYLSNSSFSRGETRCEQDRPSPTTAPPAPPSPSPSPVPESPSVDKYNVSGTNGTCLLASMGLQLNLTYERKDNTTVTRLLNINPNKTSASGSCGAHLVTLELHSEGSTVLLFLFGMNASSSRFFLQGIQLNTTLPDARDPAFKAANGSLRALQATVGNSYKCNAEEHVRVTKAFSVNIFKVWVQAFKVEGGQFGSVEECVLDENNMLIPIAVGGALAGLVLIVLIAYLVGRKRSHAGYQTI

SEQ ID NO: 10 - protein, 415 aa, Macaca mulatta
MAAPGSARRSLLLLLLLLLGLTHCASAAMFIVKNGNGTACIMANFSAAFSVNYDTKSGPKNMTFDLPSDAKVVLNSSSCGKENTSDPSLVIAFGRGQTLTLNFTRNATRYSVQLMSFVYNLSDTHLFPNASSKEIKTVESITDIRADIDKKYRCVSGTQVHMNNVTVTLHDATIQAYLSNSSFSREETRCEQDRPSPTTAPPAPPSPSPSPVPESPSVDKYNVSGTNGTCLLASMGLQLNLTYERKDNTTVTRLLNINPNKTLASGSCGAHLVTLELHSEGSTVLLFQFGMNASSSRFFLQGIQLNTTLPDARDPAFKAANSSLRALQATVGNSYKCNAEEHVRVTKAFSVNIFKVWVQAFKVEGGQFGSVEECLLDENNMLIPIAVGGALAGLVLIVLIAYLVGRKRSHAGYQT

SEQ ID NO: 11 - protein, 413 aa, Canis lupus familiaris
MAAFGGARPRPLLLLLLAGLVHGAAAVFVVKDANGTACIMANFSAAFLASYETRSGPKNVTFDLPSDAVVLNSSSCGKENTSDPSLMIAFGKGHGLTLNFTRNATRYSVQLMSFIYNLSDTQIFPNASSKETKTVESATDIRADINKKYRCVSNTQIHMHNVTVTFHDVTIQAYLANSNFSKEETRCEQDGPFPTTAPPPPPHPSPSPAPESPSVHKYNVSGANGTCLLASMGLQLNVTYKKKDNTTVVKVVSINPNKTTAGGSCGAQLVTLELRSESVTLLAFQFGMNASTSRFFLQGIQLNMTLPDARDPTFKAGNNSLRALQATIGNSYKCNAGEHVQVTEAFSVNIIKVWVQAFQVQGDKFGSVEECQLDENSMLIPIAVGGALAGLVLIVLIAYLIGRKRSHAGYQTI

SEQ ID NO: 12 - protein, 417 aa, Oryctolagus cuniculus
MEAPGGARRPLLLLLLLGLVHGASAVFVVRNSNGTACIMANFSAVFSVIYESKSGYKNASFELPATAEVQNTSSCGRENTSNPSLQIAFGRGHVLALNFTRNATLYSVPLLSFVYNLSDSDLFPNASSKDIKTVGSTTDIKADIDKRYRCVSDSKVPMGNVTVTLQDATIQAYLWNNSFSQAESRCRQDMPSPTTAPPAPPVPPSPPSPSPPPKPESPSVSRYNVSDGNATCLLASMGLQLNLTYVHRDNATVTRVFNINPNKTKPSGHCGAQQVTLELQSERSTVLVFQFGMNASSGQYFLQGVLLNTTLPDAREPAFSASNSSLRALQATLGNSYKCNSEEHVRVTPAFSLSIFKVWVQAFQVKGDKFGSVEECLLDQDSMLIPIAVGGALAGLVLVVLIAYLIGRKRSHAGYQT

SEQ ID NO: 13 - protein, 409 aa, Bos taurus
MAAPGGARRRPLLLLLFAGLVHGASAVFVVKNGNGTACIMADFSATFLTSYDTRSGPQNKSFELPAGAEVSNSSSCGKENASDSSLVITFGRGHTLTLIFTRNATRYEVQLMRFAYNLSDTDTFPNSSSTGVKTVESATDIKADINKTYRCVSETQVNMDNVTVTLRDAAIQAYLSSSNFSREETRCEQDLPTPTTPPQPAPTPAPASPAVFRYNVSGSNGTCLLASMGLQLNVTYRRVDNKTVTREFNVNPNKTTFGGNCSATLATLELHSENLLLLALQFVMNESSSRVFLQGVQLNLTLPDAKEGSFTATNSSLRALQATAGNSYKCNAEQRLRVTSSFSLNMFRVWLQAFRVDGDKFGPVEECQLDENSMLIPIAVGGALAGLVLIVLLAYLIGRKRSHAGYQTI

SEQ ID NO: 14 - protein, 407 aa, Rattus norvegicus
MAAPGARRPLLLLLLAGLAHSAPALFEVKDNNGTACIMASFSASFLTTYDAGHVSKVSNMTLPASAEVLKNSSSCGEKNASEPTLAITFGEGYLLKLTFTKNTTRYSVQHMYFTYNLSDTQFFPNASSKGPDTVDSTTDIKADINKTYRCVSDIRVYMKNVTIVLWDATIQAYLPSSNFSKEETRCPQDQPSPTTGPPSPSPPLVPTNPSVSKYNVTGDNGTCLLASMALQLNITYMKKDNTTVTRAFNINPSDKYSGTCGAQLVTLKVGNKSRVLELQFGMNATSSLFFLQGVQLNMTLPDAIEPTFSTSNYSLKALQASVGNSYKCNSEEHIFVSKALALNVFSVQVQAFRVESDRFGSVEECVQDGNNMLIPIAVGGALAGLVLIVLIAYLIGRKRSHAGYQTI

SEQ ID NO: 15 - protein, 414 aa, Gallus gallus
MGGAARAVLLGFLQASSSFDVRDSTGKVCIIANLTVAFSVEYKSSGQKQFAHFFLPQNATSQSHSSCGEGNTSHPILALSFGAGHLISLNFSKTLDKYQVEELTFHYNLSDETLFPNATEGKVMVATQKSVIQARIGTEYRCINSKYVRMKHVNITFSNVTLEAYPTNDTFSANKTECREDMVSTTTVAPTTPKHATSQVPTTSPAPTAAPSSPAVGKYNVTGANGTCVLASMGLQLNITYVKKDEKMGLDLLNFIPHNTSASGMCESTSAFLNLAFEKTKITFHFVLNASSEKFFLQGVNVSTTLPSEAKAPTFEASNDSMSESRATVGNSYKCSAEENFQVTDKALVNVFNVQVQAFKVDGDKFGAMEECQLDENNMLIPIIVGAALAGLVLIVLIAYLIGRKRSHAGYQTI

SEQ ID NO: 16 - protein, 413 aa, Sus scrofa
MAAPGGAWRRPLLLLLLLLGLARGASAVFVVSDGNGTACIMADFAAAFEISYDSRSGAKNTTFSLPASAQVLNSSSCGKENTSDSSLVIAFGRGHTLTLSFTRNATRYSVQLMTLVYNLSDAEFFPSASSKGTKTVAASTDIRADLNTKYRCVSNSQVHLLNVTVTLGNATIQAYLANNSFSQQETRCEQDKPSPPTPTAPPTPTPTPAPTSPVVSRYNVSGANGTCLLASMGLQLNVTYRTKDNTTVTRGLNINPNKTTFGGSCSAQLVTLELQGESLRLLALQFALNTSSSRVFLQGVQLNMTLPDARDPSFSAANSSLRALQATAGNSYKCRSEQRLQVTEAFALNVFQVRVQAFRVDGDKFGPAEECQLDENSMLIPIAVGGALAGLVLVVLMAYLVGRKRSHAGYQTI

SEQ ID NO: 17 - protein, 422 aa, Monodelphis domestica
MAEPGGARTPQRLLLLLLGLIHVASSIFVVKNGTGTACIMANFSATFSMNYTTKSGLESTTFRLPQNASVMNSSSCGKENTSNPILEIGFGGGHTLTMNFSSTTQSYQVELLSFSYNLSDATLFPNASKGSEESSVKSKTDIQADIHKKYRCVSSNRITMSNVTIVLSDVTIQAYLSNNTFSKEETRCSQDTPSPSPVPTTHPTTIPVPTPTPTRPPTPAEIPPIFKYNVSDANGTCLLASMGLQLNITYAKKDNSSARIIWNINPNKTVAGGSCSPQVAILELQTENSTLAFSFGMNATTSKFFLREIRFHKFFPDAKDPAFGAVNSSLKELQATVGNSYKCNAEENVHVTDGFSVNIFRVRVQAFKVEGDKFGSVEECLLDENNMLIPIAVGGALAGLVLIVLIAYLIGRKRSHAGYQTI

SEQ ID NO: 18 - protein, 415 aa, Meleagris gallopavo
MARALLAAVLLGFLQASSSFDVRDSTGKVCIIANLTVAFSVEYKSNGQKQFAHFFLPQNATSQSHSSCGEGNTSHPILALSFGAGHLLSLNFSKTLDKYQVEELTFHYNLSDETLFPNASEGKVMEVTQKSVIQARIGTEYRCINSKYIYIRHVNITFSNVTLEAYPTNGTFSTNKTECSEDMVSTTTVAPTTPKHITSQVPATSPAPTAAPSNPAVGKYNVTGANGTCVLASMGLQLNITYLKKDGKTGLDLLNFVPHNTNASGTCENTSAFLNLAFEKTKITFHFVLNASSEKFFLQGVNVSTTLPSEAKAPMFEASNDSMSELRATVGNSYKCSAEENLQVTDKALVNVFNVQVQAFKVDGDKFGAVEECQLDENNMLIPIIVGAALAGLVLIVLIAYLIGRKRSHAGYQTI

SEQ ID NO: 19 - protein, 415 aa, Taeniopygia guttata
MARGLLAAAALLGFLQASSSFEVKDSSGKVCILADLTVAFSVEYKTNVQKEFVHFFLPQNASVDSQSSCGKDNASHPILVLDFGGGHSLSLNFSESADKYQVEELVFHYNLSDATLFPNSSTGGMKTVSHKSIIQAHMGTQYRCINSKHINMKNVNVTFSNVTLEAYLTNGTLSVNKTECAEDRVSTTTMVPTTPKQTTSQSPTTGPAPTSPPNPTVGKYNVTGPNGTCVLAYMGLQLNITYQQKDEKMGLDLLNFVPHNTTSSGRCDNTSALLNLTFEKTRVIFQFALNATAEKFFLQGVSVSTTLPSEAKNPKFEATNNSMSELRASVGNSYKCSSEENLQVTDQALVNVFNVQVQIFKIDGDKFGPVEECQLDENNMLIPIIVGAALAGLVLIVLIAYLIGRKRSHAGYQTI

SEQ ID NO: 20 - protein, 418 aa, Anolis carolinensis
MVSSSSCRRGLLLAAVLLGFLQASSTFEVRDKTGKICILANFSAEFTVDYSTKAKVERKTFQLPSSAHINKESSSCGKEKETSQVLVVEFGTGNSLTFTFEKSNDFYHVSNLTFSYNLSDSSFFPNSSGGQREVSRAGDIQANINTTYRCRSNHRVNMTNVTVLFSNVTLEAYLPNNAFSKNDSVCAEDKTSTVAPPITTHIPTTTSLAPPTPPPTDTPKIGRYNVTGLHGICLLATMGLQVNVTYSTKNKTSKSELLNLPPTAEVSGTCENSSITLNLTSESTSLSFQFSQNTSTEKYFLQGIIVTANLPPEATEKNISYSNHTLNALKTSVGKSYKCIAEESIWISGKAAVNIFNIQLQAFKIPGDKFGAVEECQLDENNMLIPIIVGAALAGLVLIVLIAYLIGRKRSHAGYQTI

SEQ ID NO: 21 - protein, 418 aa, Oryzias latipes
MKSFPSFVALFIVCSAVLADTQAVVTLEVKEGNSTCIKAEFSAVFSITYNTTNDTRTVSVFLPNSTTVDSANSSCGSNGSTPGLMAKFGPGHYFGMNFSTNGSLYSVDTLFLRYNLSDASLFPEANSSGPVDFELSASVGIWAPTNTTYRCLSPTTITITRPSVTFSEMKLEAYMPGNDFSPAERVCAADQTTTGAPTTTTSAATPTTPSPTPAGTPEQGSYSVKNASGTVCLMAKMGVQLNVSYFSQSQNKTVQELLNLTPNLTSSSGLCGGTNATLVLAQEETTVLSFLFTVNSTSNKYHLSGITLQANWTDMMSPFSASNTSLDYLRSSLGHSYMCNAEQTLFVVSTFSINMFELQVQPFGVTSTQFASAEVCQIDQDQMLIPIIVGAALAGLVLIVLIAYLIGRKRSHAGYQTI

SEQ ID NO: 22 - protein, 420 aa, Takifugu rubripes
MKRSHALVVLIIAWFSLSGCIQAVSLEVKEGNSTCIKANLSAYFSITYNTSSSTRTAQFILPDSATVDPDSSTCGGNGSSPWLVAVFGAGHALGLGFSTNGSFYSVANLTLQYNLSDASVFPDANSSGVVTVVSSSVGIWAAVNTTYRCLSSVLFQVGGATVTFSDMRLEAYMPGNDLSPRESFCAADQTTTAPPTTTAAPTTTAATTMAPPAPTPPGTPVRGTYSVVNGNDTTCLLAQMGLQLNVSYFSRSQNKTVQSLVNLTPNLTNSTGSCEKGSATLILTQQTTILIFTFSLNSTSSKYHLSGLSLQANWSDMAAAFSASNASLSYLRSTFGHSYMCNAEQILAVTPVFSLNTFSLQIQPFGVTTNQFAAAEECQMDQDQMLIPIIVGASLAGLVLIVLIAYLIGRKKSHAGYQTI

SEQ ID NO: 23 - protein, 419 aa, Salmo salar
MTRTCPFVVGIACFAILGCVTVVQSQVTLEVTEGNSTCIKAELSASFSITYDTANGTRTVMVPLPGSAVVGVASSCGGDGRSPWLVALFGDGHALGLGFSSNDSLYSVAKLTLQYNLSDVSNFPEANSTDVVTVETTSVGMVARVNTTYRCISASPVIVGGATVTFSNVTMEAFMTGEDLSPNESVCTADQSFTTAPPPPPSTTTAAPAPVPTPPGTPSQGSYSVSNSNGTVCLLARMALQLNISHFSASQNKTIQEVVNLLPNQTTSSGSCDPTSATLVLTQANATNLSFLFTLNSTSNRYHLTGLSVVAAWSDMTAPFNTSNSSLDYQRGSLGRSYMCISEQTLVVDQNFSLNTFQLQVQPFGITRGQFAQAEECQLDQDNMLIPIVVGAALAGLVLIVLIAYLIGRKRSHAGYQTI

SEQ ID NO: 24 - protein, 247 aa, Oreochromis niloticus
MVQICRVQSWFVGVTPLLIFATVLHQGFATVAPPTPAPHKEPGRPERGYYNVTNHNGTICLMAYMGLQLNISYNSTSQKKVVQDVMNLQPNLTKHSGLCDSDIASLNLTVDAVKTNLTFVFTMNSTSNKYHLSEVTVSAAWPEMKEPVSVHNSSLDYLRGTVGYSYFCRDEQTLNVAQNLSINTFQLQVQPFAVKGDQFGAAEECQLDEDDMLIPIVVGAALAGLVVIVLLAYLIGRKRSHAGYQSI

SEQ ID NO: 25 - protein, 415 aa, Mus musculus
MCLSPVKGAKLILIFLFLGAVQSNALIVNLTDSKGTCLYAEWEMNFTITYETTNQTNKTITIAVPDKATHDGSSCGDDRNSAKIMIQFGFAVSWAVNFTKEASHYSIHDIVLSYNTSDSTVFPGAVAKGVHTVKNPENFKVPLDVIFKCNSVLTYNLTPVVQKYWGIHLQAFVQNGTVSKNEQVCEEDQTPTTVAPIIHTTAPSTTTTLTPTSTPTPTPTPTPTVGNYSIRNGNTTCLLATMGLQLNITEEKVPFIFNINPATTNFTGSCQPQSAQLRLNNSQIKYLDFIFAVKNEKRFYLKEVNVYMYLANGSAFNISNKNLSFWDAPLGSSYMCNKEQVLSVSRAFQINTFNLKVQPFNVTKGQYSTAQECSLDDDTILIPIIVGAGLSGLIIVIVIAYLIGRRKTYAGYQTL

SEQ ID NO: 26 - protein, 415 aa, Xenopus laevis
MGDTGAMERCACPAAVLLLSLVLMGATAFEVEIKDDKNATCIYAKLSVNITVQYETDTSSSKNITFPVPSDVTTNGSSCGSDGKAPLLVINFGNSQSWSLNFTRNNSTYSGSALIFTYNTNDTILFPDALRKGLISSTAMFLGPVPLNSTYKCISREVVVSENVTQIIYDVKLEAFMANGTLGKEIICDADKPSPVPSPTQPSTTASTAIPAPTSKPLDKPTMGNYTVSDASGICLLASMGLQINTSLLSEGKNIWRPFNIDPLGIKTNGTCTNQTGTLILTENRTIIEFTFALKNKNHFYLEEVNITLINGSAFSSRQNQNLSTWEASVDSSYMCHKEQQIKVSEDLFINAFDVRVQPFGVNNGTFATAEDCFADQNFIVPIVVGAALGVLVVLVMVAYFIGRRKQSSAGYEQM

SEQ ID NO: 27 - protein, 355 aa, Danio rerio
MAVRGFLPLLFILLSGIVHADDMMTSPLPSTAELKTANLPLVIQTTSSTTSTTTTSRPSSTSTHSTLTTEPAAKTTTARTTVTTSAPTSTQSTSSSSTSATVTTLAPTTTGHNTTNSTTEPPTTTGHNTTNSTTDAPTTTHTNATVAPTPPPTTPSVPKPTVGNYSVKTDNVSDCLLAKMGLQFSFKISGNASLQTVNLDPNVTKVNGTCGSGGSDSSLFLTSKDITVHFVFTNDSQKFRLHALTLTVDLGNGNIFNDSNTNLSLWEASVGSSYMCRKEQSYNISDKLTLNTFELQVQPFDVKKNSFSTAHECSLDDTSLLIPIIVGAALAGLIFIVVIAYVIGRRRTYVGYQTL

SEQ ID NO: 28 - protein, 411 aa, Papio anubis
MVCFRLFPVPGSGLVLVCLVLGAVQSYALELNLTDSGKATCLYAKWQMNFTVRYETTNKTYKTVTISDRGTVTYNGSICGDDQNGPKIAVQFGPGFSWIANFSKAASTYSIDSISFSYNTGDNTTFPDAEDKGIITVDELLAIKIPLNDLFRCNSLSTLEKNDVVQNYWDVLVQAFVQNGTVSTNEFLCDEDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVKNENRFYLKEVNVSMYLVNGSVFSIANNNLSYWDAPLGSSYMCNKEQTVSVSGAFQINTFDLRVQPFNVTQGKYSTAEECSADSDLNFLIPVAVGVALGFLIIVVFISYMIGRRKSRTGYQSV

SEQ ID NO: 29 - protein, 410 aa, Macaca mulatta
MVCFRLFPVPGSGLVLVCLVLGAVQSYALELNLTDSGKATCLYAKWQMNFTVRYETTNKTYKTVTISDRGTVTYNGSICGDDQNGPKIAVQFGPGFSWIANFSKAASTYSIDSISFSYNTGDNTTFPDAEDKGIITVDELLAIKIPLNDLFRCNSLSTLEKNDVVQNYWDVLVQAFVQNGTVSTNEFLCDEDKTSTVAPTIHTTVPSPTTTPTPKEKPEAGTYSVNNGNETCLLATMGLQLNITQDKVASVININPNTTHSTGSCRSHTALLRLNSSTIKYLDFVFAVKNENRFYLKEVNVSMYLVNGSVFSIANNNLSYWDAPLGSSYMCNKEQTVSVSGAFQINTFDLRVQPFNVTQGKYSTAQDCSADDDNFLVPIAVGAALAGVLILVLLAYFIGLKRHHAGYEQF

SEQ ID NO: 30 - protein, 364 aa, Pan troglodytes
  SITE (200)..(200): Xaa can be any naturally occurring amino acid
MVCFRLFPVPGSGLVLVCLVLGAVRSHALELNEADSAINCSKCKTVTISDHGTVTYNGSICGDDQNGPKIAVQFGPGFSWIANFTKAASTYSIDSISFSYNTGDNTTFPDAEDKGILTVDELLAIKIPLNDLFRCNSLSTLEKNDVVQHYWDVLVQAFVQNGTVSTNEFLCDKDKTSTVAPTVHTTVPSPTTTPTRIPPXVASVININPNTTHSTGSCRSHTALLRLNSSTIKYLDFVFAVKNENRFYLKEVNISMYLVNGSVFSIANNNLSYWDAPLGSSYMCNKEQTVSVSGAFQINTFDLRVQPFNVTQGKYSTAEECSADSDLNFLIPVAVGVALGFLIIVVFISYMIGRRKSRTGYQSV

SEQ ID NO: 31 - protein, 411 aa, Canis lupus familiaris
MVCFRLSPAPGSGLVLLCLVLGAVSSYALEVNVTDSEKATCLYAKWQMNFTIQYNTTSKNFKTATISDFSTATYNGSVCGNDQNNPKIVVQFGSGFSWIVNFTKKESAYLIDSISFSYNLSDNATFPDAKEKGILTVHDLVGFRIPLNNIFRCNSLSTLEKNGVVQYYWDVHVQAFVQNGTVSTKEFLCEKDKTSTTVVPTISTTTPSPTTTPTPKEKPEVGSYSVNNSNGTCLLATMGLQLNITHNKVASVININPNTTDFTGSCQPQTALLRLNSSNIKYLDFVFAVKNENRFYLKEVNVSMYLVNGSVFSIANNNLSYWDAPLGSSYMCNKEQTVSVSGAFQINTFDLRVQPFNVMEGKYSTAQECSLDDDTILIPIIVGAGLSGLIIVIVIAYLIGRRKSYAGYQTL

SEQ ID NO: 32 - protein, 417 aa, Equus caballus
MVCFRLSPVPGSGLVLLCLVLGAVSSYALELNLTDSEKALCLYAKWQMNFTIPYETTSKSYKTVTISNFGTPTYNGSICGDNQNGSRIAVQFGSGFSWIVNFTKSVSVYSIDSISFSYNTGDNTTFPDAKDKGILTVNESVAFKIPLNDIFRCNSLSSLVKNGVVQNYWDVHVQAFVQNGTVSTNEYLCEKDNTTTTVAPIVPTTVPSPTTTSSPTTTPSPKEKPDVGSYLVKNGSDTCLLATMGLQLNVTHDKVASVININPNVTGYSGSCHPQTALLRLNSSNIKYLDFVFAVKNENRFYLKEVNVSMYLANGSVFSFANNNLSYWDAPLGSSYMCNKEQTVSVSGEFQINTFDLRVQPFNVKDGKYSTAQDCRADDDNFLVPIAVGAALAGVLILVLLAYFIGLKRHHAGYEQF

SEQ ID NO: 33 - protein, 407 aa, Bos taurus
MVCFRLAPVPGSGFLLLCLVLGAVSSYALELNLTDSSNATCLYAKWQMNFTIRYETTDKHNKTVPISDLGAATYNGSFCGDDQNGPKIAVQFGSGFSWIVNFTKEAASPSTYLVDTISFSYNTNDNKTFPDAKEKEVFTVNNRVALKIPLNDIFRCNSLSTLENRDVVQHYWDVHVQAFVQNGTVSTTEFLCDKDKTVTTAVPIVPTTLPSPTKPVVGSYSVVNSNGTCLLATMGLQLNITHDKVASVFNINPNTTNATGSCQPQTALLRLSSSNIKYLDFVFAVKNENRFYLKEVNVSMILVNGSVYSISNTNLSYWDAPLGSSYMCNKEQTVSVSGAFQINTFDLRVQPFSVTEGKYSTAQECSLDDDTILIPIIVGAGLSGLIIVIVIAYLIGRRKSYAGYQTL

SEQ ID NO: 34 - protein, 411 aa, Sus scrofa
MVCFRLSPVPGSGLLMLCLVLGAVSSYALELNLTNSEKATCLYAKWQMNFTIRYETTNNSHKTVSISDFGAATYNGSFCGDDHNDPQIVMQFGSGFSWIVNFAKESSSYLINSISFSYNTSDTTTFPDAKKKGVLTVNDSVGFQVPLNDIFRCNSLSTLEKDNVVQHYWDVHVQAFVQNGTVSTKEFLCDKDKTLTTTVPVIPTSVPSPTTTPTPKEKPETGSYSVTSSNGTCLLANMGLQLNITQDKVASVININPNTTNATGNCHSKTALLRLSGSNIKYLDFVFAVKNDNRFYLKEVNVSVYLVNGSVFSIANNNLSYWDAPLGSSYMCNKEQTVSVSGAFQINTFNLRVQPFSVMEGKYSTAQDCSADDDNFIVPIAVGAALAGVLILVLLAYFIGLKRHHAGYEQF

SEQ ID NO: 35 - protein, 408 aa, Ovis aries
MVCFRLAPVPGCGFLLFCLVLGTVSSYALELNLTDSSKATCLYAKWQMNFTIRYETTDKHNKTVTISDFDAAAYNGSVCGDDQNGPKIAVQFGSGFSWIVNFTKEASSTSTYLVDSISFSYNTNDNATFPDAKEKGVFTVNNRVALKIPLNDIFRCNSLSTLEKSDVVQHYWDVHVQAFVQNGTVSTTEFLCDKDKTVTTAMPIVPTTAPSPTKPVVGSYSVVNSNGTCLLATMGLQLNITHDKVASVFNINPNTTNATGSCQPQTALLRLSSSNIKYLDFVFAVKNENRFYLKEVNVSMILVNGSVYSISNTNLSYWDAPLGSSYMCNKEQTVSVSGALQINTFDLRVQPFSVTEGKYSTAEECSADSDLNFLIPVAVGVALGFLIIVVFISYMIGRRKSRTGYQSV

SEQ ID NO: 36 - protein, 411 aa, Rattus norvegicus
MRLLSPVTGSKLVLLFLFLGAVRSDALKLNLTDSKGTCLYAEWEMNFTITYEALKVNETVTITVPDKVTYNGSSCGDDKNGAKIMIQYGSTLSWAVNFTKEASQYFINNITLSYNTNDTKTFPGAVPKGILTVIIPVGSQLPLGVIFKCSSVLTFNLSPVVQHYWGIHLQAFVQNGTVSKHEQVCKEDKTATTVAPIIHTTVPSPTTTLTPTSIPVPTPTVGNYTISNGNATCLLATMGLQLNITEEKVPFIFNINPATTNFTGSCQPQTAQLRLNNSQIKYLDFIFAVKNEKRFYLKEVNVNMYLANGSAFHVSNNNLSFWDAPLGSSYMCNKEQVVSVSRTFQINTFNLKVQPFNVTKGEYSTAQDCSADEDNFLVPIAVGAALGGVLILVLLAYFIGLKRHHTGYEQF

SEQ ID NO: 37 - protein, 570 aa, Ornithorhynchus anatinus
MAMKNFTLQQERDTSVALIIRTYVRAFLKVYTKVPKPQRCHNQWQSLNIEGIEGIEIVKGSKWRSALETIITIQVKRKSQVQKYHPFSLHSECQKTNQEGTGGVATVIADECLLWPSIPFSTLAQKVNLGSCEAFSIIGYSVFALFIYLKPNMLDFIELAELMLSTETQLLEPTRVCCGICQSYALEINLTDSKNATCLYSKWQMTFTINYETTGNETKNVTVTVPENVTYDGSSCGDNQTVPQIAVQFGLGYSWHLNFTKKENNSYSFDTIVFTYNTSDNETFPEAKEKGQVLSVFEFRYARIPLNKIFRCHSEESLIGDKATHHYWETVVQAFIQNGTISKEEFICSKDRASTTVAPVTTQVVPSTTATPVPQDKPYPGKYAVKNGNDTCLLATMGLQLNVTQNKVNSVININPNVTDFTGSCSNETAELRLSGSNVKYIDFIFAVKNGNRFYLKEVNVSISFVNASDLNVANNNLSYWDAPLGSSYMCNKEQTLALADSLQINTFNLRVQPFSVVAGKYSTAEDCSADDDNFIVPIAVGAALGGLVILVLMAYFVGRKRRATGYEQF

SEQ ID NO: 38 - protein, 425 aa, Gallus gallus
MAPPRCPAGLALLLLLLGACGFFQSYAVEVDVKDASNFTCLYAQWMMKFLIKYETNSSDYKNASLDLTSTVTHNGSICGSDTQAALLAVQFGDGHSWSINFTKNNETYRAEFITFTYNTNDTAVFPDARRQGPVTIVVKDAMHPIQLNNVFVCHHTTSLEAENVTQIFWNVTMQPFVQNGTISKKESRCYADTPTAAPTVLPTVANVTTASTTISPAPTTAPKPAENPVTGNYSLKTGNKTCLLATVGLQLNISQDKPLLINIDPKTTHADGTCGNTSATLKLNDGNRTLIDFTFIVNASASVQKFYLREVNVTLLNYQNGSVILSADNNNLSKWDASLGNSYMCRKEQTLEINENLQVHTFNLWVQPFLVKENKFSIAEECFADSDLNFLIPVAVGMALGFLIILVFISYIIGRRKSRTGYQSV

SEQ ID NO: 39 - protein, 556 aa, Taeniopygia guttata
MECREGEVTRCKQKNNLFSGINDDISGAKQAKQRQCTPQKPPKRATATLPLQRPPRGIPGPAPAAVAAAVAADRITPSGSHQTRPPEAARDERPVRDPRNRAAAPSGHWRRAGGPQRHRHHRHRRHGPAPLRRLLLRPPPPAAAAARFLGFFQSYAVEVDIKDASNATCLYADWMMRFLIKYESNSGDYKTTTLNLSSSVTHNGSVCGNDTQAALVAVQFGEGHSWSINITKNNETYQGDFITLTYNTNDTAVFPDAKRKGPITVLVRDPSRPIQLNTVFVCHNSFVIEAENTTQIFWNVTMQAFVQNGTVSKKESRCPADTPTSEPTVPPTIANVTTASTTTLSPAPTTAPKPVENPVTGNYSLKSGNKTCFLATVGLQLNVSQEKPLLININPKTTVADGACGNTTATLKLNDGNSTLIGFTFAVKNTSASVQKFYLREVNVTLLNRLNGSVISSADNSNLSKWDAFLGSSYMCRKEQTLQINENVQVHTFNLWIQPFLVEANKFATAEECIADSDLNFLIPIAVGVALGFLIILVFISYIIGRRKSRTGYQSV

SEQ ID NO: 40 - protein, 408 aa, Xenopus tropicalis
MERCACPAALLLLSLVLMGAMAFDVEIKDDKNATCIYAKLSVNVTVQYETNTSSTKNVTFSVPSEVTTNGSSCGSNGKAPILVINFGNGHSWSLNFTRNDSMYSGGALIFTYNTNDSTLFPDALKEGLISSTAAFLGPIPLNSTYKCISSEVVVSENVTQIISDVKLEAFMQNGTLGKEVSCDADKPSPTPTTNPSTTASTTTPTPTSKPLDNPTTGNYSVSDVNGTCLLASMGLQINTSLLSEGKNIWTAFNIDPTAMSKNGTCSNQTGTLILTDNSTVIEFTLALKNKNHFYLKEVNVALINGSASSTRQNQNLSAWEASVGSSYMCHKEQQIKVSEDLVINSFDVRVQLFGVKNETFATAQQCSLDDDSIVIPIVVGAALAGLIVIIVIAYLIGRRKGYSGYQTL

SEQ ID NO: 41 - protein, 404 aa, Salmo salar
MFRCAFLILFLALGNELHLSHGTEVSVNNTENKLCLYANLMVNFSVTYEVGVNKNETVIFVLPENVTTEGSTCDNTTSTLKLSFGHGHSWTVEFTKKNKTYQVDTIVFSYNLNDSSVFPNSTSKETKFVTVKSIITNVSVDTYYSCKSENVLTVESVIQTLYDVALQAFVINGSKSDTDTVCSADMTSTTVAPTTTVTSTAAPTSTPTLPTPTTGKYSIAPDVNSTACLMATFGLQIGYKQGDKEETINLVPNITEVGGACGANSSDLILTSDTITIMFTFSNDGKKFHLHALKVTVKPATGDPVIAVNNNMSIWAAAVGSSYMCNKEQTLNVTDTLTLYTFELRVQPFEVNKGEFATAHECSLDDTSILIPIIVGAALAGLILIVVIAYVIGRRKTYVGYQTL

SEQ ID NO: 42 - protein, 410 aa, Oreochromis niloticus
MKVSHATAGLVVWFVVLGCIDAVTLEVKESNTTCIKADLSASFSIIYNTTHAERTVQVLLPNSTTVDTANSTCGKDGSSPRLVAVFGSGYTLGLNFSTNGTLYQVSSLTLQYNLSDTSVFPNATISGVVTLVSASVGIEANVNTTYKCASPTVIDVATAKVNFTDMRLEAYMPGNELSPNETVCFADQTSTTPSPTTVSTTAVPTQTPPGTPQQGNYTVKDANDTICLLAKMGLQLNVSYTSQNKTVQDVLNLNPNVTNSTGSCGASSATLVLTQTQSTILTFNFTLNSTTNKYHLSGVTLIANWFDSAHFSMSNNSLNYLRSTLGYSYMCNAEQTLFVTPSFSLNTFDLQVQPFGVKSGRFATAEECQMDQNQMIIPIIVGAALAGLVLITLIAYLIGKRRSHAGYQAI

SEQ ID NO: 43 - protein, 249 aa, Takifugu rubripes
MTQIGGVQPVFLAVTVHLILATVLHQTFATVTPPVTTAVPHKEPGRPDQGDYQVTSSNGTVCFLASMGLQLNITFNSTSQNKTLQEVINIQPNRTKSSGSCDTSSALLTLTTDAEKTNLTFVFALNTTSNKYHLSEVSLSAALSDMKETFVAQNHSLDYLRGTLGFSYMCRERQTLGVTPDFAINTFQVQVQPFGVTGKQFAAAEECQLDKDDMLIPIIVGAALAALVLIVLSAYLIGRKRSHAGYQSI

SEQ ID NO: 44 - protein, 418 aa, Pan troglodytes
MPRQLSAAAALFASLAVILHDGSQMRAKAFPETRDYSQPSAAATVQDIKKPVQQPAKQAPHQTLAARFMDGHITFQTAATVKTPTTTPATTKNTATTSPITYTLVTTQATPNNSHTAPPVTEVTVGPSLVPYSLPPTITPPAHTTGTSSSTVSHTTGNTTQPSNQTTLPATLSIALHKSTTGQKPVQPTHAPGTTAAAHNTTRTAAPASTVPGPTLAPQPSSVKTGIYQVLNGSRLCIKAEMGIQLIVQDKESVSWGHRTITLSSKSLSGGCLARNEHSPHPLFLFFEKGPPSVTQAEDEESYYISEVGAYLTVSDPETIYQGIKHAVVMFQTAVGHSFKCVSEQSLQLSAHLQLKTTDVQLQAFDFEDDHFGNVDECSSDYTIVLPVIGAIVVGLCLMGMGVYKIRLRCQSSGYQRI

SEQ ID NO: 45 - protein, 416 aa, Papio anubis
MPRQLSAAAVLFASLAVILHDGSQMRAKAFPKTRDYSQPTAAATGQDIAKPVQQPANQAPHQTLAARLMDGHITFQTAATIKTPTTTPVTTKNTPTTSPIIYTLVTTQATSNNSHTAPPLTKVTVGPSLAPYSLPPTITPPAHTTGTSSSTVNHTTGNATQPSNQTTLPATLSIALHKSTTGQKPVQPTHAPGTTAAAHNTTRTAAPASTVPGSTLAPQPSSVKTGIYQVLNGSRLCIKAEMGIQLIVQDKESVFSPRRYFNLDPNATQASGNCGTRNSNLLLNFQGGFVNLTFTKDEGSYYISEVGACLTVSDPETIYQGMKHAVVMFQTAVGHSFKCVSEQSLQLSAHLQLKTTNVQLQAFDFEDDHFGNVDECSSDYTIVLPVIGAIVVGLCLVGIGVYKIRLRCQSSGYQRI

SEQ ID NO: 46 - protein, 416 aa, Macaca mulatta
MPRQLSAAAVLFASLAVILHDGSQMRAKAFPKTRDYSQPTAAATGQDIAKPVQQPANQAPHQTLAARLMDGHITFQTAATIKTPTTTPVTTKNTPTTSPIIYTLVTTQATSNNSHTAPPLTKVTVGPSLAPYSLPPTITPPAHTTGTSSSTVNHTTGNATQPSNQTTLPATLSIAPHKSTTGQKPVQPTHAPGTTAAAHNTTRTAAPASTVPGSTLAPQPSSIKTGIYQVLNGSRLCIKAEMGIQLIVQDKESVFSPRRYFNLDPNATQASGNCGTRNSNLLLNFQGGFVNLTFTKDEGSYYISEVGACLTVSDPETIYQGMKHAVVMFQTVVGHSFKCVSEQSLQLSAHLQLKTTNVQLQAFDFEDDHFGNVDECSSDYTIVLPVIGAIVVGLCLVGMGVYKIRLRCQSSGYQRI

SEQ ID NO: 47 - protein, 428 aa, Canis lupus familiaris
MSWQLSAAVALFVSLALILHYGSQIRAKMFPETVDFQPTTAATVRATAKPFLHLTNQVPSQTLAARSMDGHIASQRAATTSSSEPPTTHTTVKTLVTTSLVTANSTPSSSPIIYTLVTTIVTPNNSNTAAPVTEATIGPSADPGSLPTTSTPLAHTTRTNPSTLSHKTRKTTHFGNQTTLPATLSTSTHKSTSSHKSAQSTHAPGPTTAAHNTTQTASPATPASGPTLAPQPSSPKTGIYQVLNGSRLCIKAEMGIELMVQDTKSVFSPQRYFNIDPNATQTSGNCGSQKSNLLLNFQGGFVNLTFLKDENSYYINEVGAYLAVSNPEKIYQGMKSSVVMFETGVGHSFKCVSEQSIQLSTHLQLKTMNVQFQAFDFEDDHFGNVDECSSDYTVVLPVIGAIVLGLCAVGLIVYGIHLRRESSGYQRI

SEQ ID NO: 48 - protein, 430 aa, Sus scrofa
MSWRLSAVLVSFVSLAVFLHYGHHMKAKVFPEITDSSSPTTAATVQATAEPSLWKPTNHTPHKTLAAKSTDGHVTSQIATTVTDSETLTTHTTITTLAATSLAATNSTPSTSPTTHTLFTTLATPNTSHMAAPVTEAAISPSAGLSSLLPTIIPPAHTTGTRSSTLSPTAGKTTQPSNQTTLPATLSTSPHNSTASQKPTHPNHTPGPTTGAHNTTQTASPATIAPGPTLAPQPSSAKTGIYQVLNGSKLCIKAEMGIELTVQDTQSVFSPQRYFNIDPNTTQASGNCGSRKSKLLLNFQGGFVNLTFTKDENSYYVSGVGAYLTVSNPEKVYQGMKNAVVMFETMIGHSFKCVSEQSIQLSPHLQLNTMNVQLQAFDFEDDHFGNVDECSSDYTIVLPVIGAIVLGLCAVGLIVYGIRLKRESSEYQRI

SEQ ID NO: 49 - protein, 259 aa, Danio rerio
MTQSSRSVLLLMLSSLHCLGSSLESNPKDPSVLAEAPGQNKRDSDISLVPQMPVLQPKETAPPLVTYTIRNPQGKVCVRASFGVEFVVRENKKKYYFNLTPNSARATGYCANQKTVLSLEFSGGNLEFTFIKDGDQSYVKTVKGSLRAAPPCKNCPSKIYVGLVDNEKLFKAKNGLSFNCKSETMLILADYFRLKLVPLQIQAFDLVNGAFGKEVECWADYNKRMIPIILGAVAAAICLIAILTYVLVREHRNQGYEQL

SEQ ID NO: 50 - protein, 432 aa, Equus caballus
MAWQLSAVVVLFVSLAVILYYGSHVRANVFPEITDYSQPTTAATIQTRAQPSLSQPTNQVPHKTLATRSMDGQVTSQTAATTVNPETPVTHTTIKTAAATSLVTTNSTLSTSPITNTLLTTLATPDNTHTTTPVTEATIGPSAGPGSPPTTITTTSSAYTTGTRSSTVSHTTGKTTQLSNQTTLPATLSTSPHNSTTSQNPAHSTHTPGPTTGTCNTTQTASPTTTAPGPTLAPQPSSAKTGMYQILNGSKLCIKAEMGIQLTVQDTKSASPPQGYFNIDPNTTQVSGICGSRKSNLLLNFWGGFVNLTFTKDENSYYISEVGAYLTVSNPEKTYQGMKSPVVMFETVIGHSFKCVSEQSLELSTQLHLKTTNVQLQAFDFEDDNFGNVDECSSDYTVVLPVIGAIVLGLFAVGLIVYGVRVRREASGYQRI

SEQ ID NO: 51 - protein, 433 aa, Bos taurus
MSWQIPAVVMSFMALVAIWYYDSHYNSHMQAKVFPEITGYSSPTTGQATVKPSLLQPTNYVPHKTAAARSTDGHVTSQTVAKTSSSETLTTNTTIDVLATTSPVTTKSTLPTTPTTHTLVTTLATPNKSHVTFPVTEAKVGLSVGPSSPPVTVNPTAHTTGNRPSTASHTTGKTTQLSNQTTLPATLSTSPHNITTSQKPTQPTHTPGPTTATYNTTQTASPATIAPRPTLAPQPLSPKTGIYQVHNGSKLCIKAEMGIQLTVQDSVSVFSPQKYFNIDPNATQASGNCGSRKSNLLLNFQGGFVNLTFTKGEKSYYISEVEAYLTVSNPAKVYQGLKHAMMMFETVVGHSFKCVSEQSIQLSTYLQLKTMNVQLQAFDFEDDHFGNADECISDRNRREIPVAVGLSIAVLLAVLLTACLVTRKRPSRGYERM

SEQ ID NO: 52 - protein, 429 aa, Ovis aries
MSWQISAVVLFFVSLAVIWYYDSHMKANVFPEITGYSSPTTGQATVKPSLLQPTNHVPCNTAAAKSTDGHVTSQTVAKTSSPETLTTNTTIEVLVTTSPVTTQSTLPTTPTTHTLVTTLATPSKSHVTFPVTEAKAGLSIGPSSPPVTINPAAHTTGNRPSTASHTTGKTTQLSNQTTLPATLSTSPHNITTSQKPTQPTHTPGPTTAANNTTHTASPATIAPRPTLAPQPLSPKTGLYQVLNGSKLCIKAEMGIQLTVQDSVSVFSPQKYFNIDPNATQASGNCGSRKSNLLLNFQGGFVNLTFIKDENSYYISEVEAYLTVSNPAKVYQGMKYAMMMFETVVGHSFKCVSEQSIQLSNHLQLKTVNVQLQAFDFEDDRFGNADECISDRNRREIPVAVGLSIAVLLAVLLTACLVTRKRPSRGYERM

SEQ ID NO: 53 - protein, 408 aa, Rattus norvegicus
MPGQTSAVAVLLCLAVILHGYQIREKEFPEARGYLQYTATTTEQITAKPPLPLTNQTSHATLASRSKDDYIQTAAETSTFEDTAHITMKTAIPVTTKSLLPISSTSYTFVRTNNSHMTASSTEDTIGSGSITHLPFPTTRASLAAVNHITGRSTQLGGQTTLPKALFTPSHESTTTQRPTLSTIVSELTPTGKDRSTTSSVPLVPRPTFVTWSSPAKIGTYEVLNGSRLCIKAEMGIALIVQEKGLDSATQRHFNIDPSLTHASGKCGSQNSNLFLNFQGGSVNVTFTKEENLYYVSEVGAYLTISNTEKTYQGKSTMMMFETVVGHSFKCVSEQSIQLSAQLQMKTMNIHLQAFDFEGDSFGIVDECLSDYTVVLPVVGIIVVVLCVVGLGIYKIRQRRQSSAYQRI

SEQ ID NO: 54 - protein, 411 aa, Mus musculus
MPGQISAVAVLFLSLTVILHGYQIREKEFPKARGYLQYTATSAEQITTKPLLQLINQRSHITLASRFKDDYIQMAAETSAIENTAHITMKTVTPVTTKSLPPISSASYTFVRSNNAHMTASSTDDTIGSGSIAHLPVPTTRASLAIVNYITGRATQLGGQTTLPKTFFTASHKSTTNQRPTLSTNVLGTSTPTHKDRSTTSPVPLVPRPTLVTWSSPAKIGTYEVLNGSRLCIKAEMGLALIVQEKDLDSATQRYFNIDPSLTHASGKCDSQKSNLFLNFQGGSVNITFTKEENLYYISEVGAYLTISNTEKTYQGKKNTLMMFETVVGHSFKCVSEQSIQLSAQLQMKTMNIHLQAFDFEGDSFGNVNECLSDYTVVLPMVAIIVVVICVVGLSVYKIRQRHQSSAYQRI

SEQ ID NO: 55 - protein, 314 aa, Xenopus tropicalis
MDRVSLLSTILLLYGLLYINDAYSENTFAQPSNTTTPAPNTTTTHVTSNTTTLAPNTTTTHVTSNTTTLAPNTTTTHITSNTTTLAPNTTTTLAPNTTTTHSVTTTKTASTTTPTPTLEPKPSPPETGNYTVKIKNEFCIEALMGLELELTNSTKTQQYFNIVPSQINSNGTCEKSKANLNLTFANSYINFVFAQDDNSYYLDNVTVYFNLTRSESWYGNATNQKLLKTENGYSVKCKNTPKIQLGDTMNLVMTNVKLQVFNFKDNSFGKETTCKYDHNFGLMIAGIVIVVIVVLGVIIYFIWHKRKSSGYQRI

SEQ ID NO: 56 - protein, 478 aa, Pan troglodytes
MGRCCFYTAGTLSLLLLVTSVTLLVARVFQKAVDQSIEKKIVLRNGTEAFDSWEKPPLPVYTQFYFFNVTNPEEILRGETPRVEEVGPYTYRELRNKANIQFGDNGTTISAVSNKAYVFERDQSVGDPKIDLIRTLNIPVLTVIEWSQVRFLREIIEAMLKAYQQKLFVTHTVDELLWGYKDEILSLIHVFRPDISPYFGLFYEKNGTNDGDYVFLTGEDSYLNFTKIVEWNGKTSLDWWITDKCNMINGTDGDSFHPLITKDEVLYVFPSDFCRSVYITFSDYESVQGLPAFRYKVPAEILANTSDNAGFCIPEGNCLGSGVLNVSICKNGAPIIMSFPHFYQADERFVSAIEGMHPNKEDHETFVDINPLTGIILKAAKRFQINIYVKKLDDFVETGDIRTMVFPVMYLNESVHIDKETASRLKSMINTTLIITNIPYIIMALGVFFGLVFTWLACKGQGSMDEGTADERAPLIRT

SEQ ID NO: 57 - protein, 478 aa, Macaca mulatta
MGRCCFYTAGTLSLLLLVTSVTLLVARVFQKAVDQSIEKKIVLRNGTEAFDSWEKPPLPVYTQFYFFNVTNPEEILRGETPRVEEVGPYTYRELRNKANVQFGDNGTTISAVSNKAYVFERDQSVGDPKIDLIRTLNIPVLTVIEWSQVHFLREIIEAMLKAYQQKLFVTHTVDELLWGYKDEILSLIHVFRPDISPYFGLFYEKNGTNDGDYVFLTGEDNYLNFTKIVEWNGKTSLDWWITDKCNMINGTDGDSFHPLITKDEVLYVFPSDFCRSVYITFSDYESVQGLPAFRYKVPAEILANTSDNAGFCIPEGNCLGSGVLNVSICKNGAPIIMSFPHFYQADERFVSAIEGMHPNKEDHETFVDINPLTGIILKAAKRFQINIYVKKLDDFVETGDIRTMVFPVMYLNESVLIDKETASRLKSVINTTLIITNIPYIIMALGVFFGFVFTWLACKGQGSMDEGTADERAPLIRT

SEQ ID NO: 58 - protein, 478 aa, Canis lupus familiaris
MGRCCFYTVGTLSLLLLVTSIALLVARVFQKAVDQTIEKNIVLRNGSETFDSWKKPPLPVYAQFYFFNVTNPEEILRGEIPRLEEVGPYTYRELRDKADIQFGDNGTTISAVSNKAYVFERNQSVGDPKTDLIRTLNIPAVTAMEWAHLHFFRELIEALLKAYQQTLFVTHTVDELLWGYKDEILSLINVFKPEISPYFGLYYGKNGTNDGDYVFLTGEDNYLNFSKIVEWNGKTSLDWWTTDKCNMINGTDGDSFHPLIDKDEILYVFPSEFCRSVYITFSDFKSVQGLPAFRYKVPGEVLANTSDNAGFCVPKGNCLGSGVLNISICKNGAPIIISFPHFYEADKKFVSAIDGMRPNKDYHETFVDINPLTGIILRAAKRFQINVYVKKLDDFIETGNIRTMVFPVMYINESVLIDKDTASRLKSVINTTLIITNIPYIVMALGVFFGLIFTWLACRGQGSMDEGTPDERAPLIRT

SEQ ID NO: 59 - protein, 478 aa, Bos taurus
MGRCCFYAVGTLSLLLLVTSITLLVARVFQKAVDQTIEKNIVLRNGSETFDSWKKPPLPVYTQFYFFNVTNPEEILNGETPRLEEVGPYTYRELRNKDDIQFGDNGTTISAVSNKAYVFERDKSVGDPKIDLLRTLNIPALTAMEWTQLPLLRDIIEALLKAYRQKLFVTHTVDELLWGYKDEILSLINTFKHDVSPYFGLFYGKNGTNDGDYVFLTGEDNYLNFSKIVEWNGKTSLDWWTADECNMINGTDGDTFHPLITRDEVLYVFPSDFCRSVYITFSDFESVQGLPALRYKVPAEILANTSDNAGFCIPKGNCLGSGVLNVSVCKNGAPIIMSFPHFYQADEKFVSAIGGMHPNKEYHETFVDINPLTGIILRAAKRFQINVYVRKLDDFVETGNIQTLVFPVMYINESVLIDKETASRLKSVINTTLIVTNIPYIIMALGVFFGLIFTWLACRGQGSTDEGTADERAPLIRT

SEQ ID NO: 60 - protein, 478 aa, Mus musculus
MGRCCFYTAGTLSLLLLVTSVTLLVARVFQKAVDQTIEKNMVLQNGTKVFNSWEKPPLPVYIQFYFFNVTNPEEILQGEIPLLEEVGPYTYRELRNKANIQFGENGTTISAVTNKAYVFERNQSVGDPNVDLIRTINIPLLTVVDLAQLTLLRELIEAMLKAYQQKLFVIHTVHELLWGYKDEILSLVHIFKPDVSPNFGLFYERNGTNDGEYVFLTGEDNYLNFSKIVEWNGKTSLDWWTTDTCNMINGTDGDSFHPLISKDEVLYLFPSDLCRSVHITFSSFENVEGLPAFRYKVPAEILANTSENAGFCIPEGNCMDSGVLNISICKNGAPIIMSFPHFYQADEKFVSAIKGMHPNKEEHESFVDINPLTGIILRGAKRFQINTYVRKLDDFVETGDIRTMVFPVMYLNESVLIDKETANQLKSVINTTLVVTNIPYIIMALGVFFGLVFTWLACRGQGSMDEGTADERAPLIRT

SEQ ID NO: 61 - protein, 531 aa, Danio rerio
MTRRSCTIYATGIVCAHLLILGIALLLAQVFQTMIQERIKKEITLAENSRVLDGWINPPPPVYMQYFFFNVTNPDEFLAGKEKAKVTQMGPYTYREYRPRENVTYLENGTKIFATNPKSFVFLRNMSAGDPEVDRVTTVNIPMIAVMNELNSYSFFVRTAVSMYMGSMGMGLFMNRTVHEILWGFKDPLLTKLHAMRPEVDEHFGLMYNKNGTHEGEFVFHTGEKNYMNYGKIDTWNGISQMNWWSSNQSNMINGTDGSVFHTFLSRKELLYIFAADLCRSIHLGYVRDMEVKGIPAFRFAPPSDVLAPPDENPANAGFCVPAGDCLGKGVLKVSVCRQGAPIVVSFPHFYQADERYINAIEGMNPNEEEHETYLDINPTTGVPIRACKRAQLNIILKRVRGFPNTKFLNETIFPIMYVNETATIDDESAAQMRMLLLIVTVVSNFPVIILALGVILLVVLIFLVCRNRQRKNEVKRIDFTEAFHSFATTKDETAYTQVSNQAEDSPENRNNQPLRNGSYIAMSPVEAQKC

SEQ ID NO: 62 - protein, 478 aa, Rattus norvegicus
MARCCFYTAGTLSLLLLVTSVTLLVARVFQKAVDQTIEKNMVLQNGTKVFDSWEKPPLPVYIQFYFFNVTNPEEILQGEIPLLEEVGPYTYRELRNKANVQFGENGTTISAVTNKAYIFERNQSVGDPTVDLIRTINIPLLTVVEMAQQPFLREIIEAMLKAYQQTLFVTHTVHELLWGYKDEVLSLVHIFRPDVSPNFGLFYERNGTNDGEYVFLTGEDNYLNFTKIVEWNGKTSLDWWTTDTCNMINGTDGDSFHPLISKDETLYIFPSDFCRSVYITFSSFENVEGLPAFRYKVPAEILANSSENAGFCIPEGNCMDAGVLNVSICKNGAPIIMSFPHFYQADEKFVSAIKGMRPNKEEHESFVDINPLTGIILRGAKRFQINTYVKKLDDFVETGNIRTMVFPVMYLNESVLIDKETASQLKSVINTTLIVTNIPYIIMALGVFFGLIFTWLACRGQGSTDEGTADERAPLIRT

SEQ ID NO: 63 - protein, 481 aa, Gallus gallus
MRSLCLVTVGVLALTLLIASISLLVAHVFQTVVDLQVKQGTVLKNGTETFEAWEDPPPPVYMQFYFFNVTNPLEVLQGATPLVEEKGPYTYREYRPRVHVQFLDNGTKVSALNPKTYVFEPEKSVGNPEVDLIRTINVPAVTAMEWTRATSLQFATEVLLLLYQESLFTVRTVHELLWGYKDKLLSTIHVLHPEIDPVFGFFNKMNGTDDGEYVFLSGEMNYLNFSRIVEWKGKESLNWWTTKTCNMINGTDGTSFHPLISKDENIYIFSSDFCRSLYLVYDSSGSVAGVPTYRFVPSPMVFANTTVNPDNAGFCVPPGNCPGAGVLNVSICKQGAPIFLSAPHFYQADQKFVSDIEGMHPTKEYHETFVDINPLTGLVLQAAKRMQINIHVRKLPEFFETGNIRTLIFPVMYINESVLIDEASANKLKHVLLEASVVTGIPFVIMAIGIVFGIVFSVLVCRAQGAREESTEEERSPLIRT

SEQ ID NO: 64 - protein, 483 aa, Xenopus tropicalis
MVKWAVFGTAAVSVTLLIVSIVLLLTHTFMDIVEGQVKQAIVLKNESEVFEDWANPPPPVYMQFYFFNVTNPLEVLSGEKPFVDEIGPYTYREYRPRENITFSVNGTEVSAVTPKTYVFEPEKSIGDPKVDLIRTVNIPLVTILEMTKDSSLLRPFIIAALKTYKEGMFVTRTVDELLWGYKDAVLSILHPFKKNISDTFGLFYKMNTTDDGEYIFLSGEKDYLEFTQIAEWKGQKALNWWTTETCNMINGTDGTSFHPLLNKDDTIYMFSSDLCRSIYAVYESSENIKDISVFRFSPPASVFANVSVNPQNKGFCVPEGNCLPSGLLNVSICKEGAPIVLSSPHFYQADENVINSIRGMKPVKEHHMTFLDLNPLTGTLIQAAKRIQVNVYVRKINVYLITQDIQTLFFPVMHLNESVLIDDKSAGRLRSILFQGRVVANIPFIIMGLGIILAFLFTTLSCLQKRSRDEGTEEERGPLIRAS

SEQ ID NO: 65 - protein, 551 aa, Drosophila melanogaster
MQLDDILHINNCKADCSSLSTTPNPKTDLVNMNGPKHKFCTKLSSTYLRKWWITIVVAAALIIGGIVVACEFTVLIDAVVDRMVALRPGAKTFGWWAKPPVEPRISLYIYNVTNADDFLSNGSKAIVDEVGPYVYSETWEKVNIVENDNGTLSYNLRKIYSFREDLSVGPEDDVVIVPNIPMLSATSQSKHAARFLRLAMASIMDILKIKPFVQVSVGQLLWGYEDPLLKLAKDVVPKEQKLPYEEFGLLYGKNGTSSDRVTVNTGVDDIRRYGIIDNFNGRTHLPHWTTDACNTLAGTDGSIFPPHIDHDRILHVYDKDLCRLLPLVFEKEVMTSNEVPGYRFTPPEWVFADVDSHPDNMCFCPAGKPSCSPNGLFNVSLCQYDSPIMLSFPHFYLADESLRTQVEGISPPMKEKHQFFFDVQPKMGTTLRVRARIQINLAVSQVFDIKQVANFPDIIFPILWFEEGIDNLPDEVTDLMRFAEQVPPKIRVALIVGLCALGVILLLLSTFCLIRNSHRQSTLHLEGSNYLATAQVDMNKKQNKDNQPARY

SEQ ID NO: 66 - protein, 522 aa, Anopheles gambiae str. PEST
MYGRSNRLCAKLSSAFLRKWWFVIAFALSLLVLGALVTFGFTAFIRTIIDHQVALRVGGQSFGWWSRPPVEPIIRIFVYNVTNADEFLNNGTKPILDELGPYVYVQTWEKVNIKENPNGTISYNQKRVYIFNEDLSGGLEDDVVIVPNIPMLSATSQSKHAARFLRLAMASIMDILKIKPFVEVSVGQLLWGYEDPLLKLAKDVVPKEQKLPYEEFGLMYGKNSTSKDTVTVWTGVDDITQYGIIDKYNGRSHQTHWLSEQCNRLNGTDGSIFPPRITKNSTLHVYEKDLCRLLPLSFEKEVTVRGGVKGYRFTPSPDVFASVDKNPNNMCYCPAGPPCAPHGLFNVSLCQYDSPILLSFPHFYMADQTLRTAVEGISPPEKDKHQLFIDVQPDMGTALRARARIQINLAVSQVVDIKQVANFPDIVFPILWFEEGIDSLPDEILDLMKVATNIPPRAKFILTIALFGLGGFLFVVAVICLVRKSHRQSTLHLEGSNYLATASVDQAKKKAKMDNGMSSKSN

SEQ ID NO: 67 - protein, 338 aa, Homo sapiens
MVRRVQPDRKQLPLVLLRLLCLLPTGLPVRSVDFNRGTDNITVRQGDTAILRCVVEDKNSKVAWLNRSGIIFAGHDKWSLDPRVELEKRHSLEYSLRIQKVDVYDEGSYTCSVQTQHEPKTSQVYLIVQVPPKISNISSDVTVNEGSNVTLVCMANGRPEPVITWRHLTPTGREFEGEEEYLEILGITREQSGKYECKAANEVSSADVKQVKVTVNYPPTITESKSNEATTGRQASLKCEASAVPAPDFEWYRDDTRINSANGLEIKSTEGQSSLTVTNVTEEHYGNYTCVAANKLGVTNASLVLFRPGSVRGINGSISLAVPLWLLAASLLCLLSKC

SEQ ID NO: 68 - protein, 338 aa, Pan troglodytes; identical to SEQ ID NO: 67

SEQ ID NO: 69 - protein, 338 aa, Oryctolagus cuniculus
MGARVQPDRKQLPLVLLRLLCLLPTGLPVRSVDFNRGTDNITVRQGDTAILRCVVEDKNSKVAWLNRSGIIFAGHDKWSLDPRVELEKRHSLEYSLRIQKVDVYDEGSYTCSVQTQHEPKTSQVYLIVQVPPKISNISSDVTVNEGSNVTLVCMANGRPEPVITWRHLTPTGREFEGEEEYLEILGITREQSGKYECKAANEVSSADVKQVKVTVNYPPTITESKSNEATTGRQASLKCEASAVPAPDFEWYRDDTRINSANGLEIKSTEGQSSLTVTNVTEEHYGNYTCVAANKLGVTNASLVLFRPGSVRGINGSISLAVPLWLLAASLLCLLSKC

SEQ ID NO: 70 - protein, 341 aa, Mus musculus
MVGRVQPDRKQLPLVLLRLLCLLPTGLPVRSVDFNRGTDNITVRQGDTAILRCVVEDKNSKVAWLNRSGIIFAGHDKWSLDPRVELEKRHALEYSLRIQKVDVYDEGSYTCSVQTQHEPKTSQVYLIVQVPPKISNISSDVTVNEGSNVTLVCMANGRPEPVITWRHLTPLGREFEGEEEYLEILGITREQSGKYECKAANEVSSADVKQVKVTVNYPPTITESKSNEATTGRQASLKCEASAVPAPDFEWYRDDTRINSANGLEIKSTEGQSSLTVTNVTEEHYGNYTCVAANKLGVTNASLVLFSKYAKTEPDSMQVIEFLHIDLKSIRHPLKVNPIQK

SEQ ID NO: 71 - protein, 337 aa, Xenopus laevis
MVGRSQSDRNQLPLFLLRLLCLLPTGLPVRSGDFNRSTDNMTVRQGDTAILRCFVEDKSSKVAWLNRSGIIFAVDDKWSLDPRVELEKRSPFEYSLRIQKVDVSDEGPYICSVQTNQHTKTMQVYLIVQVPPKISNISADITVNEGSNVTLMCIAYGRPEPMITWRHLTPTARDFEGEEEFLEIQGITREQSGRYECKAANEVASADVKQVRVTVNYPPIITESNSNEATTGKQAILRCEASAVPAPDFEWYKDDTRINSAQGLEIRNTGSRSVLMVANVTEEHYGNYTCVAANKLGITNTSLYLYIGPGTPIDNATSLAASLWLMANILLCLFCTC

SEQ ID NO: 72 - protein, 333 aa, Danio rerio
MSCLWIHSVFIPGFFLLFGFEGFPVISVESQRSTDNITIRQGDTTVIRCYVDDKVSKVAWLNRSNIIFAGEDKWSLDPRVELVTQGQLEYSLRIQKVDVFDEGPYTCSIQTKQQSKTSQVYLIVQVPAIIYKVSEDITVNEGSNVALTCLANGRPDPAITWRLLNPSAEALDVGEYLEISGVVRSQAGRYECKASNDVSTPDVKYVNVVVNYPPYIKDVRSSETAVGQAGVLHCEASAVPQPEFEWYRDERRLSSSQSLTIQVSGSRTVLVVANVTEEDYGNYTCVATNRLGVHNASVFLYKPGMGRDINSAGCICQSLWLLLLCVSSALLQC

SEQ ID NO: 73 - protein, 197 aa, Mus musculus
MSGSSRRLLWAATCLAVLCVSAAQPNITTLAPNVTEVPTTTTKVVPTTQMPTVLPETCASFNSCVSCVNATFTNNITCFWLHCQEANKTYCANEPLSNCSQVNRTDLCSVIPPTTPVPTNSTAKPTTRPSSPTPTPSVVTSAGTTNTTLTPTSQPERKSTFDAASFIGGIVLVLGVQAVIFFLYKFCKSKERNYHTL

SEQ ID NO: 74 - protein, 197 aa, Macaca mulatta
MSRLSRSLLWAVTCLAVLCVLSAEENPTPHTNVTSLAPTSNITSAPVTSLPLVTTPAPETCEGRNSCVSCFNASTVNTTCFWIECKDESYCSHNSTVSDCQVGNTTDFCSVPTATLVPTANSTAKPTVQPSPSTTSKTVTTSGTTNTTVTPTSQPVRKSTFDAASFIGGIVLVLGVQAVIFFLYKFCKSKERNYHTL

SEQ ID NO: 75 - protein, 194 aa, Sus scrofa
MLGLSRQLLWAVGCLAALCVLTAAKNSTILPPSTTTPWLSPPTTQTTSAPPKTLPTPAPEICENRNSCISCFDANNTCFWIECKGKSYCSDNSTVSDCHVVNGTDFCSGPTVTPLPTNSTAKTTTLPSPSSASTTATTSGTTNTTLAPTTQPMRKSTFDAASFIGGIVLVLGVQAVIFFLYKFCKSKERNYHTL

SEQ ID NO: 76 - protein, 198 aa, Bos taurus
MSGLSRPLLLAVGCLAALCVITAAGNTTLAPNVTTASSPPPTTTTVPVSPTTLSPLPVTTPAPDICGSRNSCVSCVDGNATCFWIECKGKSYCSDNSTAGDCKVVNTTGFCSVPTTTPTPTNSTAKTTTLPSTTTTSTTATTSGTTNTTLSPTIQPTRKSTFDAASFIGGIVLVLGVQAVIFFLYKFCKSKERNYHTL

SEQ ID NO: 77 - protein, 198 aa, Ovis aries
MSGLSRPLLLAVGYLAALCVITAARNTTVTPNVTTPSSPPPTTATVPVSPTTLTPPPVTTPAPDICGSRNSCISCVDGNATCFWIECKGKSYCSDNSTVSDCKVVNTTGFCAVPTTTPTPTNSTAKTTTLPSTTTTSTTATTSGTANTTLTPTIQPMRKSTFDAASFIGGIVLVLGVQAVIFFLYKFCKSKERNYHTL

SEQ ID NO: 78 - protein, 198 aa, Canis lupus familiaris
MSGLSRQLCWAAACLAALCALTAAQSFSSDPNGTTTTTQATTDAATTRVTTAAPATTPAPDPCDNRNSCVSCVNTSVDATACSWIECKEKSYCSHNTTVSDCQVVNSTQLCSAPEPTMMPTNSTAKTTTQPSSSTATTTATTSGTTNITLSPTSQPGRKSTFDAASFIGGIVLILGVQAVIFFLYKFCKSKERNYHTL

SEQ ID NO: 79 - protein, 195 aa, Rattus norvegicus
MSGASRGLFWAATCLAALCLSAAQSNSSASPNVTDPPTTTSKVVPTTLTTTKPPETCESFNSCVSCVNATLTNNITCVWLDCHEANKTYCSSELVSNCTQKTSTDSCSVIPTTPVPTNSTAKPTTRPSSPTPTPSVVTSAGATNTTVTPTSQPERKSTFDAASFIGGIVLVLGVQAVIFFLYKFCKSKERNYHTL

SEQ ID NO: 80 - protein, 354 aa, Homo sapiens
MRLAVLFSGALLGLLAAQGTGNDCPHKKSATLLPSFTVTPTVTESTGTTSHRTTKSHKTTTHRTTTTGTTSHGPTTATHNPTTTSHGNVTVHPTSNSTATSQGPSTATHSPATTSHGNATVHPTSNSTATSPGFTSSAHPEPPPPSPSPSPTSKETIGDYTWTNGSQPCVHLQAQIQIRVMYTTQGGGEAWGISVLNPNKTKVQGSCEGAHPHLLLSFPYGHLSFGFMQDLQQKVVYLSYMAVEYNVSFPHAAQWTFSAQNASLRDLQAPLGQSFSCSNSSIILSPAVHLDLLSLRLQAAQLPHTGVFGQSFSCPSDRSILLPLIIGLILLGLLALVLIAFCIIRRRPSAYQAL

SEQ ID NO: 81 - protein, 354 aa, Pan troglodytes
MRLAVLFSGALLGLLAAQGTGNDCPHKKSATLLPSFTVTPTVTESTGTTSHRTTKSHKTTTHRTTTTGTASHGPTTATHNPTTTSHGNVTVHPTSNSTATSQGPSTATHSPATTSHGNATVHPTSNSTATSPGFTSSAHPEPPPPSPSPSPTSKETIGDYTWTNGSQPCVHLQAQIQIRVMYTTQGGGEAWGISVLNPNKTKVQGSCEGAHPHLLLSFPYGHLSFGFMQDLQQKAVYLSYMAVEYNVSFPHAAQWTFSAQNASLRDLQAPLGRSFSCSNSSIILSPAVHLDLLSLRLQAAQLPHTGVFGQSFSCPSDRSILLPLIIGLILLGLLALVLIAFCIIRRRPSAYQAL

SEQ ID NO: 82 - protein, 335 aa, Bos taurus
MRLAVFFSGALLGLLAAQGTGNDCPHKKSATLLPSFTVTPTATESTPSPGTTSHRTTKSHRTTTWRISTTTHTTNTTGTTSSESPTATHSPATTTSHQNTTVHPTSNITATSPGPSTRSPHPEPPPSPSPSPGSKEAIGDYTWSNGSQPCVRLQAQIQIRVLYPTQGGGEAWGISVLNPNRTKAQGGCEGTHSHLLLSFPSGQLSFGFKQDPLQSAVYLNYMAVEYNVSFPQAVQWTFSVQNSSLRDLQTPLGHSFSCRNASIIVSPALHLDLLSLKLQAAQLSPSGAFGPSFSCPNDKSILLPLIIGLILLGLLTLVLVTFCIIRRRPPTYQPL

SEQ ID NO: 83 - protein, 335 aa, Mus musculus
MRLPVCLILLGPLIAQGTEEDCPHKKAVTLLPSFTMTPTATESTASPTTSHRPTTTSHGNVTVHTSSGPTTVTHNPATTTSHGNATISHATVSPTTNGTATSPRSSTVGPHPGPPPPSPSPRSKGALGNYTWANGSQPCVQLQAQIQIRILYPIQGGRKVKLKWGLKRAWGISVLNPNKTKVQGGCDGTHPHLSLSFPYGQLTFGFKQDLHQSPSTVYLDYMAVEYNVSFPQAAQWTFMAQNSSLRELQAPLGQSFCCGNASIVLSPAVHLDLLSLRLQAAQLPDKGHFGPCFSCNRDQSLLLPLIIGLVLLGLLTLVLIAFCITRRRQSTYQPL

SEQ ID NO: 84 - protein, 354 aa, Macaca mulatta
MRLAVLFLGALLGLLAAQGTGNDCPHKKSATLLPSFTVTPTATESTGTTSHRTTKSHKTTTHRTTTTGTTSHRPTTATHNPTTTSHRNATVHPTSNSTATSQGPSTATHRPATTSHGNATVHPTSNSTATSPGLTSSAHPGPPPPSPSPSPASKETIGDYMWTNGSQPCVHLQAQIQIRVMYTTQGGGEAWGISVLNPNKTKVQGSCEGAHPHLLLSFPYGHLSFGFMQDLQQRVVYLSYMAVEYNVSFPHAAQWTFSAQNASLRDLQAPLGQSFSCSNSSIILSPAVHLDLLSLRLQAAQLPHTGVFGQSFSCPSDRSILLPLIIGLVLLGLLALVLIAFCIVRRRPSAYQAL

SEQ ID NO: 85 - protein, 330 aa, Rattus norvegicus
MRFPVCLTLLVLLVAQGTGKDCPHKKAATLLPSFTETPTTTGSTASPTTTHRPTTTSHRPTTTSHRPTTTSHRPTTTSHRPTTTSHRPTTTSHGNATVSPTTNSPGFSTVGPHPGPPPPSPSPSPSSTGALGNYTWTNGSQPCVQLQAQIQIRILYLTQGGKKAWGLSVLNPNKTKVQGGCDSAHPHLALSFPYGQLTFGFKQDRHQSHSTVYLNYMAVEYNVSFPQAAQWTFSAQNSSLQELQAPLGQSFCCGNTSIVLSPAIHLDLLSLRLQAAQLPDKGHFGPCFSCASDQSLLLPLIIGLVLLGLLTLVLIAFCVTRRRQSTYQPL

SEQ ID NO: 86 - protein, 329 aa, Canis lupus familiaris
MRPAVFFLGALVGLLAAQGTRSDCPHKKSATLLPSFTVTPTATESTGSPGTTSHSTTTAETTSHAPNTTTHQAPTTPGHRNTTIHPTTSNSTSNTTGTTGTGKPHTSTSYTQPGPGPRPPPPSPGPGPQDAIGDYTWTTGSQPCARLQARIQIGVVYPTQAGGQAWGISVLNPNSTKPWGDCDGARPHLLLSFPFGQLSFGFTQEPQQGSVYLDYLALQYNVSFPQAAQWTFSGQNASLRALQAPLGQSFSCRNASILLTPALRLDLLHLKLQAAQLPPSGAFGPSFSCPSEHFNLLPLIVGVISLGLLALALVTFCIIRRRPPTYQPL

SEQ ID NO: 87 - protein, 322 aa, Equus caballus
MRLAVLFSGALLGLLAAQETGNDCPHKKSATLLPSFTVTPTATESTASPGTTSHQTTQSHRTTTTGTTSDHPTTATHNPTTTSHGNTTVHPTTSNSTVTSPGSASSSPHPRPPPPSPSPSPGSKEAIGDYIWTNGSQPCVRLQAQIQIRVLYPTLGGGKAWGISVLNPNKTKAQGGCAHPHLLLSFPYGQLSFGFKQEPLQSTVYLNYIAVEYNVSFPQAAQWTFLVQNSSLRDLQAPLGQRFSCRNASIALSPAFHLDLLSLKLQAAQLTPTGAFGPSFSCPSDQSILLPLIIGLILLGLFALVLITFCVIRRRPPTYQAL

SEQ ID NO: 88 - protein, 305 aa, Oryctolagus cuniculus
MRLPVLFLALLGLHAASSGTTSHRTTKNPHTTSHSTATPGTTSHRPTTATPTTGHGNVTVHPTTSNTTSNTTTTTGTSPGFSTSTPHPGPPPPPPSPSPGSREAVGNYTWTNGSQPCVQLQAQIQIRVLYPTQGGGQAWGMSVLNPNRTKAQGGCEGPRPHLLLSFPYGQLSFGFKQDPGQGQSAVYLSYLAVEYNVSFPQAARWTFSAQNASLRDLQAPLGQSFSCRNASIAVSPALHLDLLSLRVQAAQLPRTGIFGPSFSCPADHPSILVPLIIGLILVGLLALVLVAFCIARRRPSAYQAL

SEQ ID NO: 89 - protein, 291 aa, Sus scrofa
MTLAVLFLGALLGLLAESTTSHRTTTPRTTTTGTTSHGPTTVTHNPATTTSHGNATVHPTSSSTATSPGSSTRPPHPGPPPPSPSPSPGSQEAIGDYTWTNGSQPCVQLQAQIQIRVLYPTQGGGEAWGISVLNPNKTKALGGCEGAHPHVRLSFPYGQLTFGFKQQPQESTVYLNYMAVEYNVSFPRAAQWTFSVQNSSLRDLQTPVGRSYSCRNASIILSTAFHLDLLSLKLQAAQLPPTGNFGPSFSCPSDQTILLPLIIGLIFLGLLILVLVTFCIIRRRPPAYQPL

SEQ ID NO: 90 - protein, 354 aa, Papio anubis
MRLAVLFSGALLGLLAAQGTGNDCPHKKSATLLPSFTVTPTATESTGTTSHRTTKSHKTTTHRTTTTGTTSHRPTTATHNPNTTSHRNATVHPTSNSTATSQGPSTATHRPATTSHGNATVHPTSNSTATSPGLTSSAHPGPPPPSPSPSPASKETIGDYMWTNGSQPCVHLQAQIQIRVMYTTQGGGEAWGISVLNPNKTKVQGSCEGAHPHLLLSFPYGHLSFGFMQDLQQRVVYLSYMAVEYNVSFPHAAQWTFSAQNASLRDLQAPLGQSFSCSNSSIILSPAVHLDLLSLRLQAAQLPHTGVFGQSFSCPSDRSILLPLIIGLVLLGLLALVLIAFCIVRRRPSAYQAL

SEQ ID NO: 91 - protein, 323 aa, Monodelphis domestica
MRLSLLLSGILLGLLAEQGAGDKCPQEKSVTLVPSFTVTTIATERSTTSPETTTSSGSTATTYRTSTAATTPHSNSTATSYSTTSEGTAVTHGTTTSPRNTSTTSTSQSVPVPPSPQPTSSPSGAVGDYIGANGSQLCVHLRAQIQMRVLYQASGGGKLWGIFVLNPNRTMAQGNCEANHSSLILSFPNGKLIFGFKQDSIKKIVYLSHLATEFNVSFPSATRWIFSVENSSLQDLQTPLGHSFSCRNRSIALSPDIHLDLLSLQLQAAQLSSSGAFGAAFSCSADLNILVPLVVGLVLLTLLILVLSAFCISRRRPPAYQPL

SEQ ID NO: 92 - protein, 263 aa, Ornithorhynchus anatinus
MGLTLPLPAQGSQCRANCPHKKSATLVPSFTVTPTATSGPTTTAHQTTTDHGTTTSHETTTSQGTSTHGTSTPHTTTTGHGTTTGHQNTSHSTTTSHGTSTPHKTTTRHPTTSHGTTTSHGTSTGHWTARPTIRPGPPPPPPSPGKAVGNYTVFNGSQPCLRLRAEIRLWVLYQAQEEGEAPPVSGAASFPPPRPRPVAGEGDGERSRVTPVASAMTVEGGSRAGFAMLGAEVRSRAPSLGRAGKTRLRIHQPVVVLQHTYYV

SEQ ID NO: 93 - protein, 280 aa, Homo sapiens
MDLQGRGVPSIDRLRVLLMLFHTMAQIMAEQEVENLSGLSTNPEKDIFVVRENGTTCLMAEFAAKFIVPYDVWASNYVDLITEQADIALTRGAEVKGRCGHSQSELQVFWVDRAYALKMLFVKESHNMSKGPEATWRLSKVQFVYDSSEKTHFKDAVSAGKHTANSHHLSALVTPAGKSYECQAQQTISLASSDPQKTVTMILSAVHIQPFDIISDFVFSEEHKCPVDEREQLEETLPLILGLILGLVIMVTLAIYHVHHKMTANQVQIPRDRSQYKHMG

SEQ ID NO: 94 - protein, 280 aa, Pan troglodytes
MDLRGRAVPSIDRLRVLLMLFHTMAQIMAEQEVENLSGLSTNPEKDIFVVRENGTTCLMAEFAAKFIVPYDVWASNYVDLITEQADIALTRGAEVKGRCGHSESELQVFWVDRAYALKMLFVKESHNMSKGPEATWRLSKVQFVYDSSEKTHFKDAVSAGKHTANSHHLSALVTPAGKSYECQAQQTISLASSDLQKTVTMILSAVHIQPFDIISDFVFSEEHKCPVDEREQLEETLPLILGLILGLVIMVTLAIYHVHHKMTANQVQIPRDRSQYKHMG

SEQ ID NO: 95 - protein, 280 aa, Macaca mulatta
MDLQGRAVPSVDRLRVLLMLFHTMAQIMAEQEVENLSGLSTNPEKDIFVVRENGTTCLMAEFAAKFIVPYDVWASNYVDLITEQADIALTRGAEVKGRCGHSESELQVFWVDRAYALKMLFVKESHNTSKGPEATWRLSKVQFVYDSSEKTHFKDAVSAGKHTANSHHLSALVTPAGKSYECQAQQTISLASSDPQKMVTMILSAVHIQPFDIISDFVFSEEHKCPVDEREQLEETLPLILGLILGLVIVVTLTIYHVHHKMTANQVQIPRDRSQYKHMG

SEQ ID NO: 96 - protein, 280 aa, Canis lupus familiaris
MDLRGRAFPSVYRLRVLLMLFYTMARITAEQEVENLSGLSTNPEKDIFVVRENGTTCLMAEFAAKFIVPYDVWASNYVDLITEQADISLTRGAEVKGHCGHNESELQVFWVDRAYALKMLFVKESRNASKGPEATWRLSKVQFVYDSSEKTHFKDAVSAGKHTANSHRLSALVTPAGKSYECQAQQSISLASSDPQKTVTMILSAVHIQPFDIISDFVFSEEHKCPVDEREQLEETLPLILGLILGLVIVVTLAIYHIHHKMTANQVQIPRDRSQYKHMG

SEQ ID NO: 97 - protein, 280 aa, Bos taurus
MDLRRRALLGVDGLRVLLMLFHTVTRIMAEQEVENLSGLSTNPEKDIFVVRENGTTCLMAEFAAKFIVPYDVWASNYVDLITEQADISLTRGAEVKGHCGHDESELQVFWVDRAYALKMLFLKESHNTPKGPEATWKLSKVQFVYDSSEKTHFKDAVSAGKHTANSHHLSALVTPAGKSYECQAQQTISLASSDPQKTVTMILSAVHIQPFDIISDFVFSEEHKCPVDEREQLEETLPLILGLILGLVIVVTLVIYHIHHKMTANQVQIPRDRSQYKHMG

SEQ ID NO: 98 - protein, 280 aa, Mus musculus
MDLRVRTLLGGDRLRILLMFFHVMVQTVAEQEVENLSGLSTNPEKDIFVVRENGTTCLMAEFAAKFIVPYDVWASNYVDLITEQAEISLTRGAEVKGHCGHNESELEVFWVDHAYTLRMLFVKESHNTSKGPEATWNLNKVHFVYDSSEKTHFKAPVKVNKYIASSHHLSALVTPAGMSYECQAQQTISLASSDPQKTVTMILSAVHIQPFDIISDFVFSEEHKCPVDEQEQLEETLPLILGLILGLVIVITLVIYHIHHKMTANQVQIPRDRSQYKHMG

SEQ ID NO: 99 - protein, 280 aa, Rattus norvegicus
MDLRGRALLGGDRLRILLMFFHAMAQTVAEQEVENLSGLSTNPEKDIFVVRENGTTCLMAEFAAKFIVPYDVWASNYVDLITEQAEISLTRGAEVKGRCGHNESELQVFWVDRAYTLKMLFVKESHNTSKGLEATWKLSKVQFVYDSSEKTHFKDAVSAGKHTANSHHLSALVTPAGMSYECQAQQTISLASSDPQKTVTMILSAVHIQPFDIISDFVFSEEHKCPVDEREQLEETLPLILGLILGLVIVITLVIYHIHHKMTANQVQIPRDRSQYKHMG

SEQ ID NO: 100 - protein, 299 aa, Gallus gallus
MAAGRLPGLLFLLHAAARLAAEQEVENLSGLSPNPEKDIFVVRENRTTCLMAEFAAKFVVPYDVWASNYVDLITEQADIPLSRGAEMKGKCGTNESELEISWLERAYTLKLFFLKVRGCPRRLGRGRCAAALRGPDQPCPPQEGHNTSRGPEAFWRLSRIQFSYDTSERTYFKDAVSPGKHTASSHRLSALVTPAGKSYECQAQQTISLISSDHQKSVQLLLSEVRIQPFDITADFVFSEEHKCPVDQREQLEETLPLILGLILGLVIVITLCVYHIHHKLTANQVQIPRDRSQYKHMG

SEQ ID NO: 101 - protein, 276 aa, Xenopus tropicalis
MDYRACTSALRMPVLLLLLCTFSCNLAEQEVENLSGLSSNPDKNIFAIRENGTTCLMAEFSARILVPYEVPSSNEVDWDLEEASIQLPRDTEIRGKCWNNESELHLSWLDKAYTLKLFFSKEGQDASKSRSWKMSKIQFLYDPSEHTIFKSGARPGRHTANSHHLSLMVTPAGMSYECEATQRISLTSTDHQKIVVLYLSEVHLQPFDIKSDFVYSEEYKCPTDQRKQLEETLPLILGLTLGVAILIIVAVYHIHHKMTANQVQIPRDRSLYKHMG

SEQ ID NO: 102 - protein, 338 aa, Rattus norvegicus
MVGRVQPDRKQLPLVLLRLLCLLPTGLPVRSVDFNRGTDNITVRQGDTAILRCVVEDKNSKVAWLNRSGIIFAGHDKWSLDPRVELEKRHALEYSLRIQKVDVYDEGSYTCSVQTQHEPKTSQVYLIVQVPPKISNISSDVTVNEGSNVTLVCMANGRPEPVITWRHLTPLGREFEGEEEYLEILGITREQSGKYECKAANEVSSADVKQVKVTVNYPPTITESKSNEATTGRQASLKCEASAVPAPDFEWYRDDTRINSANGLEIKSTEGQSSLTVTNVTEEHYGNYTCVAANKLGVTNASLVLFRPGSVRGINGSISLAVPLWLLAASLFCLLSKC

SEQ ID NO: 103 - protein, 338 aa, Equus caballus
MVGRVQPDRKQLPLVLLRLLCLLPTGLPVRSVDFNRGTDNITVRQGDTAILRCVVEDKNSKVAWLNRSGIIFAGHDKWSLDPRVELEKRHSLEYSLRIQKVDVYDEGSYTCSVQTQHEPKTSQVYLIVQVPPKISNISSDVTVNEGSNVTLVCMANGRPEPVITWRHLTPTGREFEGEEEYLEILGITREQSGKYECKAANEVSSADVKQVKVTVNYPPTITESKSNEATTGRQASLKCEASAVPAPDFEWYRDDTRITSANGLEIKSTEGQSSLTVANVTEEHYGNYTCVAANNLGVTNASLVLFRPGSVRGINGSISLAVPLWLLAASLLCLLSKC

SEQ ID NO: 104 - protein, 338 aa, Sus scrofa
MVARVQPDRKQLPLVLLRLLCLLPTGLPVRSVDFNRGTDNITVRQGDTAILRCVVEDKNSKVAWLNRSGIIFAGHDKWSLDPRVELEKRHSLEYSLRIQKVDVYDEGSYTCSVQTQHEPKTSQVYLIVQVPPKISNISSDVTVNEGSNVTLVCMANGRPEPVITWRHLTPTGRELEGEEEYLEILGITREQSGKYECKAANEVSSADVKQVKVTVNYPPTITESKSNEATTGRKASLKCEASAVPAPDFEWYRDDTRINSANGLEIKSTEGQSSLTVTNVTEEHYGNYTCVAANNLGVTNASLVLFRPGSVRGINGSISLAVPLWLLAASLLCLLSKC

SEQ ID NO: 105 - protein, 338 aa, Bos taurus
MVARVQPDRKQLPLVLLRLLCLLPTGLPVRSVDFNRGTDNITVRQGDTAILRCVVEDKNSKVAWLNRSGIIFAGHDKWSLDPRVELEKRHSLEYSLRIQKVDVYDEGSYTCSVQTQHEPKTSQVYLIVQVPPKISNISSDVTVNEGSNVTLVCMANGRPEPVITWRHLTPTGREFEGEEEYLEILGITREQSGKYECKAANEVSSADVKQVKVTVNYPPTITESKSNEATTGRKASLKCEASAVPAPDFEWYRDDTRINSANGLEIKSTEGQSSLTVTNVTEEHYGNYTCVAANNLGMTNASLVLFRPGSVRGINGSISLAVPLWLLAASLLCLLSKC

SEQ ID NO: 106 - protein, 417 aa, Anopheles gambiae str. PEST
MSFAGEAASQILNKAEPLFISRSEAFKFAVGDTITLPCEVASPGTYVLAWKRGIAILTAGSVKVTPDPRVRLVNGYSLQIRDAVPQDAGDYICQIAMLDPREITHSVEILVPPKITHVTSGGHLQVRKGSPVRLECSATGNPMPNITWTRKNNLLPNGEEQFTNPVYVIENMDRHKGGTYICTANNGVGQVATSQIILHVLYPPEISVENPTVYSGEGQEAMLVCIVHGESQPEVLWHKDTMQIDQTERHVIENRGARHTLIIRKVHPQDFGNYSCIADNQLGKTRKTVTLTGKPKTAVFRSVPNSQWKDKYNISWIVDSHSPIEEFKLYYRQMTFSIGQLQPLQTDWRDIVLPAFPYSHHYTQGMSYLIRGLEPDQQYEARVQSRNRYGWSDFSESFLFTTSNTGKWMGQCCTNPG

SEQ ID NO: 107 - protein, 334 aa, Xenopus tropicalis
MRPCLLHSIWMLGFVLCLLSLQGLPVRSGDFNRSTDNITVRQGDTAILRCFVEDRSSRVAWLNRSGIIFAGDDKWSLDPRVELEKRSLLEYSLRIQKVDVSDEGPYTCSVQTKQHTKTTQVYLIVQVPPKISNISADITVNEGSNVTLMCIAYGRPEPMITWRHLTPTARDFEGEEEFLEIQGITREQSGRYECKAANEVASADVKQVRVTVNYPPIITESKSNEATTGKQAILRCEASAVPAPDFEWYKDDTRINSAQGLEIRNTGSRSVLMVANVTEEHYGNYTCVAANKLGITNTSLYLYIGPGTPIDSATSLAASLWLMANLLFCLFCTC

SEQ ID NO: 108 - protein, 338 aa, Canis lupus familiaris
MLGARRPPRSQLPLVLLRLLCLLPTGLPVRSVDFNRGTDNITVRQGDTAILRCVVEDKNSKVAWLNRSGIIFAGHDKWSLDPRVELEKRHSLEYSLRIQKVDVYDEGSYTCSVQTQHEPKTSQVYLIVQVPPKISNISSDVTVNEGSNVTLVCMANGRPEPVITWRHLTPTGREFEGEEEYLEILGITREQSGKYECKAANEVSSADVRQVKVTVNYPPTITESKSNEATTGRKASLKCEASAVPAPDFEWYRDDTRINSANGLEIKSTEGQSSLTVTNVTEEHYGNYTCVAANNLGVTNASLVLFRPGSVRGINGSISLAVPLWLLAASLLCLLSKC

SEQ ID NO: 109 - protein, 338 aa, Monodelphis domestica
MVGRVHPDRKQLPLVLLRLLCLLPTGLPVRGVDFTRGTDNITVRQGDTAILRCYVEDKSSKVAWLNRSGIIFAGHDKWSLDPRVELEKRTALEYSLRIQKVDVYDEGSYTCSVQTQHQPKTSQVYLIVQVPPKISNISSDVTVNEGSNVTLVCMANGRPEPVITWRHLTPTGREFEGEEEYLEILGITREQSGKYECKAANEVSSADVKQVKVTVNYPPTITESKSNEATTGRQASLKCEASAVPAPDFEWYRDDTRINSANGLEIKSIEGQSLLMVTNVTEEHYGNYTCVAANKLGVTNASLILFRPGSVRGINGSISLAVPLWLLAASLFCLLSKC

SEQ ID NO: 110 - protein, 338 aa, Gallus gallus
MVARAQPDRKQLPLVLLRLLCLLPTGLPVRSVDFTRGTDNITVRQGDTAILRCFVEDRSSKVAWLNRSGIIFAGEDKWSLDPRVELEKRSPLEYSLRIQKVDVYDEGSYTCSVQTQHHPKTSQVYLIVQVPPKISNISSDITVNEGSNVTLVCMANGRPEPVITWRHLTPTGKEFEGEEEYLEILGITREQSGKYECKAANEVASADVKQVRVTVNYPPTITESKSNEAATGRQALLRCEASAVPTPDFEWYRDDTRINSANGLEIKSTGSQSLLMVANVTEEHYGNYTCVAANKLGVTNASLYLYRPGTGRVDNGSVSLAVPLWLLAASLLCLLSKC

SEQ ID NO: 111 - protein, 335 aa, Taeniopygia guttata
MRTYWLHSIWVLGFFLSLFSLQGLPVRSVDFTRGTDNITVRQGDTAILRCYVEDRSSKVAWLNRSGIIFAGEDKWSLDPRVELEKRNPLEYSLRIQKVDVYDEGSYTCSVQTQHHPKTSQVYLIVQVPPKISNISSDITVNEGSNVTLVCMANGRPEPVITWRHLTPTGKEFEGEEEYLEILGITREQSGKYECKAANEVASADVKQVRVTVNYPPTITESKSNEAATGRQALLRCEASAVPTPDFEWYRDDTRINSANGLEIKSTGSQSLLMVANVTEEHYGNYTCVAANKLGVTNASLYLYRPGTGRVDNGSMSLAVPLWLLAASLLCLLSKC

SEQ ID NO: 112 - protein, 334 aa, Xenopus tropicalis; identical to SEQ ID NO: 107

SEQ ID NO: 113 - protein, 337 aa, Oreochromis niloticus
MQVGRKSCWRQLQASFFRLLCLIPTGFPVRSVDMQRATDNITIRQGDTAIIRCYVDDKVSKVAWLNRSNIIFAGQDKWSLDPRVDLVTKGQLEYSLRIQKVDVYDEGSYTCSIQTKQQPKTSQVYLIVQVPASIYQVSNDITVNEGSNVTLSCLANGRPDPAITWRLLNPSAEPLDGEEYLDIIGIMRTQAGRYECKASNDVATPDVKYVNVIVNYPPTIKKTQSSETPVGRNGTLRCEVTAVPTPEFEWYRDDKRLANTQSITIQTSGTTTSLTIANITEEDYGNYTCVASNRLGVQNASLFLYRPGTGRDINGSACVSQSLWLLLASFACLFLKC

SEQ ID NO: 114 - DNA, 492 bp, ARTIFICIAL SEQUENCE
  Synthetic
ctcgagatgggcgtgttctgctacgaggacgaggccacaagcgtgatccctcccgccagactgttcaagagcttcgtgctggacgccgacaatctgatccccaaagtggccccccagcacttcaccagcgccgagaatctggaaggcaatggcggacccggcaccatcaagaagatcacattcgccgagggcaacgagttcaagtacatgaagcacaaagtggaagagatcgaccacgccaacttcaagtactgctacagcatcatcgaaggcggccctctgggccacacactggaaaagatcagctacgagatcaagatggccgctgcccctcacggcggaggcagcattctgaagatcaccagcaagtaccacaccaagggcaacgccagcatcaacgaggaagaaatcaaggccggcaaagagaaagccgccggactgtttaaggccgtggaagcctatctgctggcccaccccgatgcctacgaattc

SEQ ID NO: 115 - protein, 160 aa, ARTIFICIAL SEQUENCE
  Synthetic
MGVFCYEDEATSVIPPARLFKSFVLDADNLIPKVAPQHFTSAENLEGNGGPGTIKKITFAEGNEFKYMKHKVEEIDHANFKYCYSIIEGGPLGHTLEKISYEIKMAAAPHGGGSILKITSKYHTKGNASINEEEIKAGKEKAAGLFKAVEAYLLAHPDAY

SEQ ID NO: 116 - DNA, 906 bp, ARTIFICIAL SEQUENCE
  Synthetic
ctcgagatcaacgtgggactgcggagacagcagcagcggtacttcggcgagtgcaatctggaccggctgaacgctctggaacccaccaacagaatcgaggccgaggcttgccagatcgagagctgggaccacaacgaccagcagttccagtgtgctggcgtggccgtgatcagacggaccatcgagcccaacggactgctgctgccccagtacagcaatgcccccgagctgatctacatcgagcggggcagaggaatcaccggcgtgctgtttcccggctgccccgagacattcgaggaccctcagcagcagagccagcaaggccagagacaaggccaaggccagtcccagagaagcgagcaagaccggcaccagaagatccggcacttcagagagggcgacatcattgctctgccagccggcgtggcccactggtgctacaatgatggcgatagccccgtcgtgaccgtgtctctgctgcacaccaacaactacgccaaccagctggacgagaaccccagacacttctatctggccggcaaccccgacgacgagcaccagaggcaagggcagcagcagttcggccagagaagaaggcagcagcagcacagccatggcgagcaaggcgagcaagagcagcaaggcgagggcaacaacgtgttcagcggcttcgacgccgagtttctggccgacgccttcaacgtggacgtggacacagccagacggctgcagtccaaccaagacaagcggcggaacatcgtgaaagtggaaggccggctccaagtcgtgcggcccgagagatctagacaagagtgggagcggcaagagcggcaagaacgcgagagcgagcaagagagagagcggcagagaaggcaaggcggcagaggcagagatgtgaacgaattc

SEQ ID NO: 117 - protein, 298 aa, ARTIFICIAL SEQUENCE
  Synthetic
INVGLRRQQQRYFGECNLDRLNALEPTNRIEAEACQIESWDHNDQQFQCAGVAVIRRTIEPNGLLLPQYSNAPELIYIERGRGITGVLFPGCPETFEDPQQQSQQGQRQGQGQSQRSEQDRHQKIRHFREGDIIALPAGVAHWCYNDGDSPVVTVSLLHTNNYANQLDENPRHFYLAGNPDDEHQRQGQQQFGQRRRQQQHSHGEQGEQEQQGEGNNVFSGFDAEFLADAFNVDVDTARRLQSNQDKRRNIVKVEGRLQVVRPERSRQEWERQERQERESEQERERQRRQGGRGRDVN

SEQ ID NO: 118 - DNA, 1410 bp, ARTIFICIAL SEQUENCE
  Synthetic
catatgctcgagatgggcgtgttctgctacgaggacgaggccacaagcgtgatccctcccgccagactgttcaagagcttcgtgctggacgccgacaatctgatccccaaagtggccccccagcacttcaccagcgccgagaatctggaaggcaatggcggacccggcaccatcaagaagatcacattcgccgagggcaacgagttcaagtacatgaagcacaaagtggaagagatcgaccacgccaacttcaagtactgctacagcatcatcgaaggcggccctctgggccacacactggaaaagatcagctacgagatcaagatggccgctgcccctcacggcggaggcagcattctgaagatcaccagcaagtaccacaccaagggcaacgccagcatcaacgaggaagaaatcaaggccggcaaagagaaagccgccggactgtttaaggccgtggaagcctatctgctggcccaccccgatgcctacggcggagggggcatcaacgtgggactgcggagacagcagcagcggtacttcggcgagtgcaatctggaccggctgaacgctctggaacccaccaacagaatcgaggccgaggcttgccagatcgagagctgggaccacaacgaccagcagttccagtgtgctggcgtggccgtgatcagacggaccatcgagcccaacggactgctgctgccccagtacagcaatgcccccgagctgatctacatcgagcggggcagaggaatcaccggcgtgctgtttcccggctgccccgagacattcgaggaccctcagcagcagagccagcaaggccagagacaaggccaaggccagtcccagagaagcgagcaagaccggcaccagaagatccggcacttcagagagggcgacatcattgctctgccagccggcgtggcccactggtgctacaatgatggcgatagccccgtcgtgaccgtgtctctgctgcacaccaacaactacgccaaccagctggacgagaaccccagacacttctatctggccggcaaccccgacgacgagcaccagaggcaagggcagcagcagttcggccagagaagaaggcagcagcagcacagccatggcgagcaaggcgagcaagagcagcaaggcgagggcaacaacgtgttcagcggcttcgacgccgagtttctggccgacgccttcaacgtggacgtggacacagccagacggctgcagtccaaccaagacaagcggcggaacatcgtgaaagtggaaggccggctccaagtcgtgcggcccgagagatctagacaagagtgggagcggcaagagcggcaagaacgcgagagcgagcaagagagagagcggcagagaaggcaaggcggcagaggcagagatgtgaacgaattcgtcgac

SEQ ID NO: 119 - protein, 462 aa, ARTIFICIAL SEQUENCE
  Synthetic
MGVFCYEDEATSVIPPARLFKSFVLDADNLIPKVAPQHFTSAENLEGNGGPGTIKKITFAEGNEFKYMKHKVEEIDHANFKYCYSIIEGGPLGHTLEKISYEIKMAAAPHGGGSILKITSKYHTKGNASINEEEIKAGKEKAAGLFKAVEAYLLAHPDAYGGGGINVGLRRQQQRYFGECNLDRLNALEPTNRIEAEACQIESWDHNDQQFQCAGVAVIRRTIEPNGLLLPQYSNAPELIYIERGRGITGVLFPGCPETFEDPQQQSQQGQRQGQGQSQRSEQDRHQKIRHFREGDIIALPAGVAHWCYNDGDSPVVTVSLLHTNNYANQLDENPRHFYLAGNPDDEHQRQGQQQFGQRRRQQQHSHGEQGEQEQQGEGNNVFSGFDAEFLADAFNVDVDTARRLQSNQDKRRNIVKVEGRLQVVRPERSRQEWERQERQERESEQERERQRRQGGRGRDVN

SEQ ID NO: 120 - DNA, 1053 bp, ARTIFICIAL SEQUENCE
  Synthetic
ctcgaggccagacagagccagctgagcccccagaatcagtgccagctgaaccagctgcaagccagagagcccgacaaccggattcaagccgaggccggccagatcgagacatggaacttcaaccaagaggacttccagtgtgccggcgtggccgccagcagaatcaccatccagcggaacggactgcatctgcccagctacagcaacgccccccagctgatctacatcgtgcaaggcagaggcgtgctgggcgccgtgtttagcggatgccccgagacattcgaggaaagccagcagagcagccagcaaggccggcagcaagagcaagaacaagagagacaacagcagcagcaaggggagcaaggcagacagcaaggacagcaagagcagcagcaagagcgccaaggacggcagcaagggcgccagcagcaagaagagggcagacagcaagaacagcagcaaggccagcaagggcggcctcagcagcagcagcagttccggcagttcgaccggcaccagaaaacccggcggatcagagaaggcgacgtggtggctattccagccggggtggcctactggtcctacaacgacggcgaccaagaactggtggccgtgaatctgttccacgtgtccagcgaccacaaccagctggaccagaacccccggaagttctatctggctggcaaccccgagaacgagttcaaccagcaagggcagagccagcccagacagcaaggcgaacaaggacggcccggacagcaccagcagcctttcggcagaccacggcagcaagagcagcaaggcagcggcaacaacgtgttcagcggcttcaacacccagctgctggcccaagctctgaacgtgaacgaggaaaccgcccggaatctgcaaggccagaacgacaacagaaaccagatcatcagagtgcggggcaatctggacttcgtgcagccccctagagggcggcaagagagagagcacgaagagaggcagcaagaacagctgcagcaagagcggcagcagcaaggcggacagctgatggccaacgaattc

SEQ ID NO: 121 - protein, 347 aa, ARTIFICIAL SEQUENCE
  Synthetic
ARQSQLSPQNQCQLNQLQAREPDNRIQAEAGQIETWNFNQEDFQCAGVAASRITIQRNGLHLPSYSNAPQLIYIVQGRGVLGAVFSGCPETFEESQQSSQQGRQQEQEQERQQQQQGEQGRQQGQQEQQQERQGRQQGRQQQEEGRQQEQQQGQQGRPQQQQQFRQFDRHQKTRRIREGDVVAIPAGVAYWSYNDGDQELVAVNLFHVSSDHNQLDQNPRKFYLAGNPENEFNQQGQSQPRQQGEQGRPGQHQQPFGRPRQQEQQGSGNNVFSGFNTQLLAQALNVNEETARNLQGQNDNRNQIIRVRGNLDFVQPPRGRQEREHEERQQEQLQQERQQQGGQLMAN

SEQ ID NO: 122 - DNA, 1548 bp, ARTIFICIAL SEQUENCE
  Synthetic
ctcgagaagatcgaccccgagctgaagcagtgcaagcaccagtgcaaagtgcagcggcagtacgacgagcagcagaaagaacagtgcgtgaaagagtgcgagaagtactacaaagagaagaagggccgcgagcgcgagcacgaagaggaagaggaagaatggggcaccggcggagtggacgagccttctacacacgagcccgccgagaaacatctgagccagtgcatgagacagtgcgaacggcaagagggcggccagcagaaacagctgtgccggttccggtgccaagagcggtacaagaaagagcggggccagcacaactacaagagagaggacgacgaggacgaagatgaggacgaggctgaggaagaggacgagaacccctacgtgttcgaggatgaggacttcaccaccaaagtgaaaaccgagcaaggcaaagtggtgctgctgcccaagttcacccagaagtccaagctgctgcacgctctggaaaagtaccggctggccgttctggtggccaaccctcaagccttcgtggtgcccagccacatggacgccgacagcatcttcttcgtgtcttggggcagaggcaccatcaccaagattctggaaaacaagcgcgagagcatcaacgtgcggcaaggcgacatcgtgtccatcagcagcggcacccccttctacattgccaacaacgacgagaacgagaagctgtatctggtgcagtttctgcggcccgtgaatctgcccggccactttgaagtgttccacggacccggcggagagaaccccgagagcttctacagagccttcagctgggaaattctggaagccgctctgaaaacatccaaggacacactggaaaagctgttcgagaagcaagaccaagggaccatcatgaaggccagcaaagaacagatccgggccatgagcagaagaggcgagggccccaagatctggcccttcaccgaggaaagcaccggcagcttcaagctgtttaagaaggaccccagccagagcaacaaatacgggcagctgtttgaggccgagcggatcgactaccccccactggaaaagctggacatggtggtgtcctacgccaatatcaccaagggcggcatgagcgtgcccttttacaacagcagagccaccaagatcgccatcgtggtgtccggcgagggctgcgtggaaatcgcttgccctcatctgagcagcagcaagtccagccaccccagctacaagaagctgcgggccagaatccggaaggacaccgtgttcatcgtgccagccggccacccttttgccacagtggccagcggcaacgagaatctggaaatcgtgtgcttcgaagtgaacgccgagggcaacatccggtacacactggccggcaagaagaacatcatcaaagtgatggaaaaggaagccaaagaactggcctttaagatggaaggcgaggaagtggacaaagtgttcggcaagcaagatgaagagttcttctttcaaggccccgagtggcgcaaagagaaagagggcagagccgacgaggaattc

SEQ ID NO: 123 - protein, 512 aa, ARTIFICIAL SEQUENCE
  Synthetic
KIDPELKQCKHQCKVQRQYDEQQKEQCVKECEKYYKEKKGREREHEEEEEEWGTGGVDEPSTHEPAEKHLSQCMRQCERQEGGQQKQLCRFRCQERYKKERGQHNYKREDDEDEDEDEAEEEDENPYVFEDEDFTTKVKTEQGKVVLLPKFTQKSKLLHALEKYRLAVLVANPQAFVVPSHMDADSIFFVSWGRGTITKILENKRESINVRQGDIVSISSGTPFYIANNDENEKLYLVQFLRPVNLPGHFEVFHGPGGENPESFYRAFSWEILEAALKTSKDTLEKLFEKQDQGTIMKASKEQIRAMSRRGEGPKIWPFTEESTGSFKLFKKDPSQSNKYGQLFEAERIDYPPLEKLDMVVSYANITKGGMSVPFYNSRATKIAIVVSGEGCVEIACPHLSSSKSSHPSYKKLRARIRKDTVFIVPAGHPFATVASGNENLEIVCFEVNAEGNIRYTLAGKKNIIKVMEKEAKELAFKMEGEEVDKVFGKQDEEFFFQGPEWRKEKEGRADE

SEQ ID NO: 124 - DNA, 1383 bp, ARTIFICIAL SEQUENCE
  Synthetic
ctcgagctgagcgtgtgctttctgattctgttccacggctgtctggccagccggcaagaatggcagcagcaagacgagtgccagatcgaccggctggacgctctggaacccgacaaccgggtggaatacgaggccggcacagtggaagcttgggaccccaaccacgagcagttcagatgtgccggcgtggcactcgtgcggcacaccatccagccaaacggactgctgctgccccagtacagcaacgccccccagctgatctatgtggtgcaaggcgagggcatgaccggcatcagctatcccggctgccccgagacatatcaagcccctcagcaaggcagacagcaaggccagagcggccggttccaagaccggcaccagaagatccggcggttcagacggggcgacatcattgccattccagccggggtggcccactggtgctacaacgagggcaatagccccgtcgtgaccgtgacactgctggacgtgtccaacagccagaaccagctggaccggaccccccggaagtttcatctggccggcaaccccaaggacgtgttccagcaacagcagcagcaccagagccggggcagaaatctgttcagcggcttcgacaccgagctgctggccgaggcttttcaagtggacgagcggctgatcaagcagctgaagtccgaggacaacagaggcggcatcgtgaaagtgaaggacgacgagctgagagtgatccggcccagcagaagccagagcgagagaggcagcgagagcgaggaagagtctgaggacgagaagcggagatggggccagcgggacaacggcatcgaagagacaatctgcaccatgcggctgaaagagaacatcaacgaccccgccagagccgacatctacacccccgaagtgggccggctgacaactctgaactctctgaatctgcccattctgaagtggctgcagctgtccgtggaaaagggggtgctgtacaagaacgctctggtgctgcctcactggaatctgaacagccacagcatcatctacggctgcaagggcaagggccaagtccaagtggtggacaacttcggcaacagagtgttcgacggcgaagtgcgcgagggccagatgctcgtggtgccccagaatttcgccgtcgtgaagcgggccagagaagaaagattcgagtggatcagcttcaagaccaacgaccgggccatgaccagccctctggccggaagaacatctgtgctgggcggcatgcccgaggaagtgctggctaacgccttccagatcagcagagaggacgcccggaagatcaagttcaacaaccagcagaccacactgaccagcggcgagagcagccaccacatgagagatgacgccgaattc

SEQ ID NO: 125 - protein, 457 aa, ARTIFICIAL SEQUENCE
  Synthetic
LSVCFLILFHGCLASRQEWQQQDECQIDRLDALEPDNRVEYEAGTVEAWDPNHEQFRCAGVALVRHTIQPNGLLLPQYSNAPQLIYVVQGEGMTGISYPGCPETYQAPQQGRQQGQSGRFQDRHQKIRRFRRGDIIAIPAGVAHWCYNEGNSPVVTVTLLDVSNSQNQLDRTPRKFHLAGNPKDVFQQQQQHQSRGRNLFSGFDTELLAEAFQVDERLIKQLKSEDNRGGIVKVKDDELRVIRPSRSQSERGSESEEESEDEKRRWGQRDNGIEETICTMRLKENINDPARADIYTPEVGRLTTLNSLNLPILKWLQLSVEKGVLYKNALVLPHWNLNSHSIIYGCKGKGQVQVVDNFGNRVFDGEVREGQMLVVPQNFAVVKRAREERFEWISFKTNDRAMTSPLAGRTSVLGGMPEEVLANAFQISREDARKIKFNNQQTTLTSGESSHHMRDDA

SEQ ID NO: 126 - DNA, 366 bp, ARTIFICIAL SEQUENCE
  Synthetic
ctcgagagcatctaccgggccatcgtggaagtggaagaggacagcggcagagagcagagctgccagcggcagttcgaggaacagcagcggttcagaaactgccagagatacgtgaagcaagaagtgcagagaggcggcagatacaaccagagacaagagtctctgagagagtgctgccaagagctgcaagaagtggaccggcgctgccggtgccagaatctggaacagatggtgcgccagctgcagcagcaagagcagatcaagggcgaggaagtgcgcgagctgtacgagacagccagcgagctgcctcggatctgcagcatcagcccaagccaaggctgccagttccagagcagctacgaattc

SEQ ID NO: 127 - protein, 118 aa, ARTIFICIAL SEQUENCE
  Synthetic
SIYRAIVEVEEDSGREQSCQRQFEEQQRFRNCQRYVKQEVQRGGRYNQRQESLRECCQELQEVDRRCRCQNLEQMVRQLQQQEQIKGEEVRELYETASELPRICSISPSQGCQFQSSY

SEQ ID NO: 128 - DNA, 3297 bp, ARTIFICIAL SEQUENCE
  Synthetic
ctcgagctgagcgtgtgctttctgattctgttccacggctgtctggccagccggcaagaatggcagcagcaagacgagtgccagatcgaccggctggacgctctggaacccgacaaccgggtggaatacgaggccggcacagtggaagcttgggaccccaaccacgagcagttcagatgtgccggcgtggcactcgtgcggcacaccatccagccaaacggactgctgctgccccagtacagcaacgccccccagctgatctatgtggtgcaaggcgagggcatgaccggcatcagctatcccggctgccccgagacatatcaagcccctcagcaaggcagacagcaaggccagagcggccggttccaagaccggcaccagaagatccggcggttcagacggggcgacatcattgccattccagccggggtggcccactggtgctacaacgagggcaatagccccgtcgtgaccgtgacactgctggacgtgtccaacagccagaaccagctggaccggaccccccggaagtttcatctggccggcaaccccaaggacgtgttccagcaacagcagcagcaccagagccggggcagaaatctgttcagcggcttcgacaccgagctgctggccgaggcttttcaagtggacgagcggctgatcaagcagctgaagtccgaggacaacagaggcggcatcgtgaaagtgaaggacgacgagctgagagtgatccggcccagcagaagccagagcgagagaggcagcgagagcgaggaagagtctgaggacgagaagcggagatggggccagcgggacaacggcatcgaagagacaatctgcaccatgcggctgaaagagaacatcaacgaccccgccagagccgacatctacacccccgaagtgggccggctgacaactctgaactctctgaatctgcccattctgaagtggctgcagctgtccgtggaaaagggggtgctgtacaagaacgctctggtgctgcctcactggaatctgaacagccacagcatcatctacggctgcaagggcaagggccaagtccaagtggtggacaacttcggcaacagagtgttcgacggcgaagtgcgcgagggccagatgctcgtggtgccccagaatttcgccgtcgtgaagcgggccagagaagaaagattcgagtggatcagcttcaagaccaacgaccgggccatgaccagccctctggccggaagaacatctgtgctgggcggcatgcccgaggaagtgctggctaacgccttccagatcagcagagaggacgcccggaagatcaagttcaacaaccagcagaccacactgaccagcggcgagagcagccaccacatgagagatgacgccggcggagggggcaagatcgaccccgagctgaagcagtgcaagcaccagtgcaaagtgcagcggcagtacgacgagcagcagaaagaacagtgcgtgaaagagtgcgagaagtactacaaagagaagaagggccgcgagcgcgagcacgaagaggaagaggaagaatggggcaccggcggagtggacgagccttctacacacgagcccgccgagaaacatctgagccagtgcatgagacagtgcgaacggcaagagggcggccagcagaaacagctgtgccggttccggtgccaagagcggtacaagaaagagcggggccagcacaactacaagagagaggacgacgaggacgaagatgaggacgaggctgaggaagaggacgagaacccctacgtgttcgaggatgaggacttcaccaccaaagtgaaaaccgagcaaggcaaagtggtgctgctgcccaagttcacccagaagtccaagctgctgcacgctctggaaaagtaccggctggccgttctggtggccaaccctcaagccttcgtggtgcccagccacatggacgccgacagcatcttcttcgtgtcttggggcagaggcaccatcaccaagattctggaaaacaagcgcgagagcatcaacgtgcggcaaggcgacatcgtgtccatcagcagcggcacccccttctacattgccaacaacgacgagaacgagaagctgtatctggtgcagtttctgcggcccgtgaatctgcccggccactttgaagtgttccacggacccggcggagagaaccccgagagcttctacagagccttcagctgggaaattctggaagccgctctgaaaacatccaaggacacactggaaaagctgttcgagaagcaagaccaagggaccatcatgaaggccagcaaagaacagatccgggccatgagcagaagaggcgagggccccaagatctggcccttcaccgaggaaagcaccggcagcttcaagctgtttaagaaggaccccagccagagcaacaaatacgggcagctgtttgaggccgagcggatcgactaccccccactggaaaagctggacatggtggtgtcctacgccaatatcaccaagggcggcatgagcgtgcccttttacaacagcagagccaccaagatcgccatcgtggtgtccggcgagggctgcgtggaaatcgcttgccctcatctgagcagcagcaagtccagccaccccagctacaagaagctgcgggccagaatccggaaggacaccgtgttcatcgtgccagccggccacccttttgccacagtggccagcggcaacgagaatctggaaatcgtgtgcttcgaagtgaacgccgagggcaacatccggtacacactggccggcaagaagaacatcatcaaagtgatggaaaaggaagccaaagaactggcctttaagatggaaggcgaggaagtggacaaagtgttcggcaagcaagatgaagagttcttctttcaaggccccgagtggcgcaaagagaaagagggcagagccgacgagggcggagggggcagcatctaccgggccatcgtggaagtggaagaggacagcggcagagagcagagctgccagcggcagttcgaggaacagcagcggttcagaaactgccagagatacgtgaagcaagaagtgcagagaggcggcagatacaaccagagacaagagtctctgagagagtgctgccaagagctgcaagaagtggaccggcgctgccggtgccagaatctggaacagatggtgcgccagctgcagcagcaagagcagatcaagggcgaggaagtgcgcgagctgtacgagacagccagcgagctgcctcggatctgcagcatcagcccaagccaaggctgccagttccagagcagctacgaattc

SEQ ID NO: 129 - protein, 1095 aa, ARTIFICIAL SEQUENCE
  Synthetic
LSVCFLILFHGCLASRQEWQQQDECQIDRLDALEPDNRVEYEAGTVEAWDPNHEQFRCAGVALVRHTIQPNGLLLPQYSNAPQLIYVVQGEGMTGISYPGCPETYQAPQQGRQQGQSGRFQDRHQKIRRFRRGDIIAIPAGVAHWCYNEGNSPVVTVTLLDVSNSQNQLDRTPRKFHLAGNPKDVFQQQQQHQSRGRNLFSGFDTELLAEAFQVDERLIKQLKSEDNRGGIVKVKDDELRVIRPSRSQSERGSESEEESEDEKRRWGQRDNGIEETICTMRLKENINDPARADIYTPEVGRLTTLNSLNLPILKWLQLSVEKGVLYKNALVLPHWNLNSHSIIYGCKGKGQVQVVDNFGNRVFDGEVREGQMLVVPQNFAVVKRAREERFEWISFKTNDRAMTSPLAGRTSVLGGMPEEVLANAFQISREDARKIKFNNQQTTLTSGESSHHMRDDAGGGGKIDPELKQCKHQCKVQRQYDEQQKEQCVKECEKYYKEKKGREREHEEEEEEWGTGGVDEPSTHEPAEKHLSQCMRQCERQEGGQQKQLCRFRCQERYKKERGQHNYKREDDEDEDEDEAEEEDENPYVFEDEDFTTKVKTEQGKVVLLPKFTQKSKLLHALEKYRLAVLVANPQAFVVPSHMDADSIFFVSWGRGTITKILENKRESINVRQGDIVSISSGTPFYIANNDENEKLYLVQFLRPVNLPGHFEVFHGPGGENPESFYRAFSWEILEAALKTSKDTLEKLFEKQDQGTIMKASKEQIRAMSRRGEGPKIWPFTEESTGSFKLFKKDPSQSNKYGQLFEAERIDYPPLEKLDMVVSYANITKGGMSVPFYNSRATKIAIVVSGEGCVEIACPHLSSSKSSHPSYKKLRARIRKDTVFIVPAGHPFATVASGNENLEIVCFEVNAEGNIRYTLAGKKNIIKVMEKEAKELAFKMEGEEVDKVFGKQDEEFFFQGPEWRKEKEGRADEGGGGSIYRAIVEVEEDSGREQSCQRQFEEQQRFRNCQRYVKQEVQRGGRYNQRQESLRECCQELQEVDRRCRCQNLEQMVRQLQQQEQIKGEEVRELYETASELPRICSISPSQGCQFQSSY

SEQ ID NO: 130 - DNA, 381 bp, ARTIFICIAL SEQUENCE
  Synthetic
ctcgagcggaccaccatcaccaccatggaaatcgacgaggacatcgacaaccccagaagaagaggcgagggctgccaagagcagatccagcggcagcagaatctgaaccactgccagtactatctgaggcagcagagcagaagcggcggctacgacgaggataaccagagacagcacttcagacagtgctgccagcagctgagccagatcgaggaacagtgccagtgcgagggactgagacaagccgtgcggagacaacagcagcagcaaggactgcggggcgaagagatggaagaaatggtgcagagcgccagagatctgcccaaagagtgcggcatcagcagccagagatgcgagatccggcggagttggttcgaattc

SEQ ID NO: 131 - protein, 123 aa, ARTIFICIAL SEQUENCE
  Synthetic
RTTITTMEIDEDIDNPRRRGEGCQEQIQRQQNLNHCQYYLRQQSRSGGYDEDNQRQHFRQCCQQLSQIEEQCQCEGLRQAVRRQQQQQGLRGEEMEEMVQSARDLPKECGISSQRCEIRRSWF

SEQ ID NO: 132 - DNA, 1791 bp, ARTIFICIAL SEQUENCE
  Synthetic
ctcgagagaggccgggacgacgacgatgaggaaaaccccagagatccccgcgagcagtaccggcagtgccaagagtactgcagaaggcaaggccaaggccagagacagcagcagcagtgccagatcagatgcgaggaacggctggaagaggaccagcggagccaagaggaacgcgagcggagaagaggcagagatgtggacgaccagaacccccgggaccccgagcagagatacgagcagtgtcagcagcagtgtgaacggcagcggagaggccaagagcagacactgtgtcggcggagatgcgagcagcggcggcagcaagaggaaagagaacgccagcggggcagagacagacaagacccccagcagcagtaccaccggtgccagagaagatgccagatccaagaacagagccccgagcggcagcgccagtgccagcagagatgcgaaagacagtacaaagagcagcaaggcagagagaggggcccagaggccagccctagaagagagtccagaggacgggaagaagaacagcagcggcacaacccctactacttccacagccagagcatcagaagccggcacgagagcgaagagggcgaagtgaagtatctggaacggttcaccgagcggaccgagctgctgagaggcatcgagaactaccgggtcgtgattctggacgccaaccccaacacatccatgctgccccaccacaaggacgccgagtctgtggccgtcgtgacaaggggcagagccacactgacactggtgtcccaagagactcgcgagagcttcaatctggaatgcggcgacgtgatccgggtgccagctggggctacagtgtacgtgatcaaccaagacagcaacgagcggctggaaatggtcaagctgctgcagcccgtgaacaaccccggccagttcagagagtactacgccgctggcgccaagtcccccgaccagagctatctgcgggtgttcagcaacgacattctggtggccgctctgaatacccctcgggacagactggaaagattcttcgatcagcaagagcagcgcgagggcgtgatcatcagagccagccaagagaagctgcgggctctgagccagcacgccatgtctgctggacagaggccttggggcagaagaagctctggcggccctatctctctgaagtccgagagcccctcctacagcaaccagtttggccagttcttcgaggcttgccccgaggaacaccggcagctgcaagaaatggacgtgctcgtgaactacgccgagatcaagaggggcgccatgatggtgccccactacaacagcaaggccaccgtggtggtgtacgtggtggaaggcaccggcagatacgagatggcatgcccccacgtgtccagccagtcttacgagggccaaggacgcagagagcaagaagaggaagagtccaccggacggttccagaaagtgaccgccagactggccagaggcgacatcttcgtgatcccagccggacaccctatcgccatcaccgccagccagaacgagaatctgcggctgctgggcttcgacatcaacggcgagaacaaccagcgggactttctggccggacagaacaacatcatcaaccagctggaacgggaagccaaagaactgagcttcaacatgccccgcgaggaaatcgaagagattttcgagagccagatggaaagctacttcgtgcccaccgagcgccagagcagaaggggccaagggcgggatcacccactggcctctattctggatttcgccttcttcgaattc

SEQ ID NO: 133 - protein, 593 aa, ARTIFICIAL SEQUENCE
  Synthetic
RGRDDDDEENPRDPREQYRQCQEYCRRQGQGQRQQQQCQIRCEERLEEDQRSQEERERRRGRDVDDQNPRDPEQRYEQCQQQCERQRRGQEQTLCRRRCEQRRQQEERERQRGRDRQDPQQQYHRCQRRCQIQEQSPERQRQCQQRCERQYKEQQGRERGPEASPRRESRGREEEQQRHNPYYFHSQSIRSRHESEEGEVKYLERFTERTELLRGIENYRVVILDANPNTSMLPHHKDAESVAVVTRGRATLTLVSQETRESFNLECGDVIRVPAGATVYVINQDSNERLEMVKLLQPVNNPGQFREYYAAGAKSPDQSYLRVFSNDILVAALNTPRDRLERFFDQQEQREGVIIRASQEKLRALSQHAMSAGQRPWGRRSSGGPISLKSESPSYSNQFGQFFEACPEEHRQLQEMDVLVNYAEIKRGAMMVPHYNSKATVVVYVVEGTGRYEMACPHVSSQSYEGQGRREQEEEESTGRFQKVTARLARGDIFVIPAGHPIAITASQNENLRLLGFDINGENNQRDFLAGQNNIINQLEREAKELSFNMPREEIEEIFESQMESYFVPTERQSRRGQGRDHPLASILDFAFF

SEQ ID NO: 134 - DNA, 2172 bp, ARTIFICIAL SEQUENCE
  Synthetic
ctcgagcggaccaccatcaccaccatggaaatcgacgaggacatcgacaaccccagaagaagaggcgagggctgccaagagcagatccagcggcagcagaatctgaaccactgccagtactatctgaggcagcagagcagaagcggcggctacgacgaggataaccagagacagcacttcagacagtgctgccagcagctgagccagatcgaggaacagtgccagtgcgagggactgagacaagccgtgcggagacaacagcagcagcaaggactgcggggcgaagagatggaagaaatggtgcagagcgccagagatctgcccaaagagtgcggcatcagcagccagagatgcgagatccggcggagttggttcggcggagggggcagaggccgggacgacgacgatgaggaaaaccccagagatccccgcgagcagtaccggcagtgccaagagtactgcagaaggcaaggccaaggccagagacagcagcagcagtgccagatcagatgcgaggaacggctggaagaggaccagcggagccaagaggaacgcgagcggagaagaggcagagatgtggacgaccagaacccccgggaccccgagcagagatacgagcagtgtcagcagcagtgtgaacggcagcggagaggccaagagcagacactgtgtcggcggagatgcgagcagcggcggcagcaagaggaaagagaacgccagcggggcagagacagacaagacccccagcagcagtaccaccggtgccagagaagatgccagatccaagaacagagccccgagcggcagcgccagtgccagcagagatgcgaaagacagtacaaagagcagcaaggcagagagaggggcccagaggccagccctagaagagagtccagaggacgggaagaagaacagcagcggcacaacccctactacttccacagccagagcatcagaagccggcacgagagcgaagagggcgaagtgaagtatctggaacggttcaccgagcggaccgagctgctgagaggcatcgagaactaccgggtcgtgattctggacgccaaccccaacacatccatgctgccccaccacaaggacgccgagtctgtggccgtcgtgacaaggggcagagccacactgacactggtgtcccaagagactcgcgagagcttcaatctggaatgcggcgacgtgatccgggtgccagctggggctacagtgtacgtgatcaaccaagacagcaacgagcggctggaaatggtcaagctgctgcagcccgtgaacaaccccggccagttcagagagtactacgccgctggcgccaagtcccccgaccagagctatctgcgggtgttcagcaacgacattctggtggccgctctgaatacccctcgggacagactggaaagattcttcgatcagcaagagcagcgcgagggcgtgatcatcagagccagccaagagaagctgcgggctctgagccagcacgccatgtctgctggacagaggccttggggcagaagaagctctggcggccctatctctctgaagtccgagagcccctcctacagcaaccagtttggccagttcttcgaggcttgccccgaggaacaccggcagctgcaagaaatggacgtgctcgtgaactacgccgagatcaagaggggcgccatgatggtgccccactacaacagcaaggccaccgtggtggtgtacgtggtggaaggcaccggcagatacgagatggcatgcccccacgtgtccagccagtcttacgagggccaaggacgcagagagcaagaagaggaagagtccaccggacggttccagaaagtgaccgccagactggccagaggcgacatcttcgtgatcccagccggacaccctatcgccatcaccgccagccagaacgagaatctgcggctgctgggcttcgacatcaacggcgagaacaaccagcgggactttctggccggacagaacaacatcatcaaccagctggaacgggaagccaaagaactgagcttcaacatgccccgcgaggaaatcgaagagattttcgagagccagatggaaagctacttcgtgcccaccgagcgccagagcagaaggggccaagggcgggatcacccactggcctctattctggatttcgccttcttcgaattc

SEQ ID NO: 135 - protein, 720 aa, ARTIFICIAL SEQUENCE
  Synthetic
RTTITTMEIDEDIDNPRRRGEGCQEQIQRQQNLNHCQYYLRQQSRSGGYDEDNQRQHFRQCCQQLSQIEEQCQCEGLRQAVRRQQQQQGLRGEEMEEMVQSARDLPKECGISSQRCEIRRSWFGGGGRGRDDDDEENPRDPREQYRQCQEYCRRQGQGQRQQQQCQIRCEERLEEDQRSQEERERRRGRDVDDQNPRDPEQRYEQCQQQCERQRRGQEQTLCRRRCEQRRQQEERERQRGRDRQDPQQQYHRCQRRCQIQEQSPERQRQCQQRCERQYKEQQGRERGPEASPRRESRGREEEQQRHNPYYFHSQSIRSRHESEEGEVKYLERFTERTELLRGIENYRVVILDANPNTSMLPHHKDAESVAVVTRGRATLTLVSQETRESFNLECGDVIRVPAGATVYVINQDSNERLEMVKLLQPVNNPGQFREYYAAGAKSPDQSYLRVFSNDILVAALNTPRDRLERFFDQQEQREGVIIRASQEKLRALSQHAMSAGQRPWGRRSSGGPISLKSESPSYSNQFGQFFEACPEEHRQLQEMDVLVNYAEIKRGAMMVPHYNSKATVVVYVVEGTGRYEMACPHVSSQSYEGQGRREQEEEESTGRFQKVTARLARGDIFVIPAGHPIAITASQNENLRLLGFDINGENNQRDFLAGQNNIINQLEREAKELSFNMPREEIEEIFESQMESYFVPTERQSRRGQGRDHPLASILDFAFF

SEQ ID NO: 136 - skipped

SEQ ID NO: 137 - protein, 371 aa, ARTIFICIAL SEQUENCE
  Synthetic
AEDLQEILPVNETRRLTTSGAYNIIDGCWRGKADWAENRKALADCAQGFGKGTVGGKDGDIYTVTSELDDDVANPKEGTLRFGAAQNRPLWIIFERDMVIRLDKEMVVNSDKTIDGRGAKVEIINAGFTLNGVKNVIIHNINMHDVKVNPGGLIKSNDGPAAPRAGSDGDAISISGSSQIWIDHCSLSKSVDGLVDAKLGTTRLTVSNSLFTQHQFVLLFGAGDENIEDRGMLATVAFNTFTDNVDQRMPRCRHGFFQVVNNNYDKWGSYAIGGSASPTILSQGNRFCAPDERSKKNVLGRHGEAAAESMKWNWRTNKDVLENGAIFVASGVDPVLTPEQSAGMIPAEPGESALSLTSSAGVLSCQPGAPC

SEQ ID NO: 138-140 - skipped (3 entries)

SEQ ID NO: 141 - protein, 159 aa, ARTIFICIAL SEQUENCE
  Synthetic
GVFNYETETTSVIPAARLFKAFILDGDNLFPKVAPQAISSVENIEGNGGPGTIKKISFPEGFPFKYVKDRVDEVDHTNFKYNYSVIEGGPIGDTLEKISNEIKIVATPDGGSILKISNKYHTKGDHEVKAEQVKASKEMGETLLRAVESYLLAHSDAYN

SEQ ID NO: 142-144 - skipped (3 entries)

SEQ ID NO: 145 - protein, 156 aa, ARTIFICIAL SEQUENCE
  Synthetic
QDTPALGKDTVAVSGKWYLKAMTADQEVPEKPDSVTPMILKAQKGGNLEAKITMLTNGQCQNITVVLHKTSEPGKYTAYEGQRVVFIQPSPVRDHYILYCEGELHGRQIRMAKLLGRDPEQSQEALEDFREFSRAKGLNQEILELAQSETCSPGGQ

SEQ ID NO: 146-148 - skipped (3 entries)

SEQ ID NO: 149 - protein, 246 aa, ARTIFICIAL SEQUENCE
  Synthetic
AIGDKPGPNITATYGSKWLEARATFYGSNPRGAAPDDHGGACGYKDVDKPPFDGMTACGNEPIFKDGLGCRACYEIKCKEPVECSGEPVLVKITDKNYEHIAAYHFDLSGKAFGAMAKKGQEDKLRKAGELTLQFRRVKCKYPSGTKITFHIEKGSNDHYLALLVKYAAGDGNIVAVDIKPRDSDEFIPMKSSWGAIWRIDPKKPLKGPFSIRLTSEGGAHLVQDDVIPANWKPDTVYTSKLQFGA

SEQ ID NO: 150-152 - skipped (3 entries)

SEQ ID NO: 153 - protein, 303 aa, ARTIFICIAL SEQUENCE
  Synthetic
RPASIKTFEEFKKAFNKNYATVEEEEVARKNFLESLKYVEANKGAINHLSDLSLDEFKNRYLMSAEAFEQLKTQFDLNAETSACRINSVNVPSELDLRSLRTVTPIRMQGGCGSCWAFSGVAATESAYLAYRNTSLDLSEQELVDCASQHGCHGDTIPRGIEYIQQNGVVEERSYPYVAREQRCRRPNSQHYGISNYCQIYPPDVKQIREALTQTHTAIAVIIGIKDLRAFQHYDGRTIIQHDNGYQPNYHAVNIVGYGSTQGDDYWIVRNSWDTTWGDSGYGYFQAGNNLMMIEQYPYVVIM

SEQ ID NO: 154-156 - skipped (3 entries)

SEQ ID NO: 157 - protein, 223 aa, ARTIFICIAL SEQUENCE
  Synthetic
TSACRINSVNVPSELDLRSLRTVTPIRMQGGCGSCWAFSGVAATESAYLAYRNTSLDLSEQELVDCASQHGCHGDTIPRGIEYIQQNGVVEERSYPYVAREQRCRRPNSQHYGISNYCQIYPPDVKQIREALTQTHTAIAVIIGIKDLRAFQHYDGRTIIQHDNGYQPNYHAVNIVGYGSTQGDDYWIVRNSWDTTWGDSGYGYFQAGNNLMMIEQYPYVVIM

SEQ ID NO: 158-160 - skipped (3 entries)

SEQ ID NO: 161 - protein, 129 aa, ARTIFICIAL SEQUENCE
  Synthetic
DQVDVKDCANHEIKKVLVPGCHGSEPCIIHRGKPFQLEAVFEANQNTKTAKIEIKASIDGLEVDVPGIDPNACHYMKCPLVKGQQYDIKYTWNVPKIAPKSENVVVTVKVMGDDGVLACAIATHAKIRD

SEQ ID NO: 162-164 - skipped (3 entries)

SEQ ID NO: 165 - protein, 129 aa, ARTIFICIAL SEQUENCE
  Synthetic
DQVDVKDCANNEIKKVMVDGCHGSDPCIIHRGKPFTLEALFDANQNTKTAKIEVKASLDGLEIDVPGIDTNACHFVKCPLVKGQQYDIKYTWNVPKIAPKSENVVVTVKLIGDNGVLACAIATHGKIRD

SEQ ID NO: 166-168 - skipped (3 entries)

SEQ ID NO: 169 - protein, 212 aa, ARTIFICIAL SEQUENCE
  Synthetic
TNACSINGNAPAEIDLRQMRTVTPIRSGVAATESAYLAYRNQSLDLAEQELVDCASQHNGCHGDTIPRGIEYIQHNGVVQESYYRYVAREQSCRRPNAQRFGISNYCQIYPQNVNKIREALAQTHSAIAVIIGIKDLDAFRHYDGRTIIQRDNGYQPNYHAVNIVGYSNAQGVDYWIVRNSWDTNWGDNGYGYFAANIDLMMIEEYPYVVIL

SEQ ID NO: 170-172 - skipped (3 entries)

SEQ ID NO: 173 - protein, 177 aa, ARTIFICIAL SEQUENCE
  Synthetic
EICPAVKRDVDLFLTGTPDEYVEQVAQYKALPVVLENARILKNCVDAKMTEEDKENALSLLDKIYTSPLCGGGGSGGGGSGGGGSVKMAETCPIFYDVFFAVANGNELLLDLSLTKVNATEPERTAMKKIQDCYVENGLISRVLDGLVMTTISSSKDCMGEAVQNTVEDLKLNTLGR

SEQ ID NO: 174 - protein, 162 aa, ARTIFICIAL SEQUENCE
  Synthetic
EICPAVKRDVDLFLTGTPDEYVEQVAQYKALPVVLENARILKNCVDAKMTEEDKENALSLLDKIYTSPLCVKMAETCPIFYDVFFAVANGNELLLDLSLTKVNATEPERTAMKKIQDCYVENGLISRVLDGLVMTTISSSKDCMGEAVQNTVEDLKLNTLGR

SEQ ID NO: 175-177 - skipped (3 entries)

SEQ ID NO: 178 - protein, 584 aa, ARTIFICIAL SEQUENCE
  Synthetic
EAHQSEIAHRFNDLGEEHFRGLVLVAFSQYLQQCPFEDHVKLVNEVTEFAKGCVADQSAANCEKSLHELLGDKLCTVASLRDKYGEMADCCEKKEPERNECFLQHKDDNPGFGQLVTPEADAMCTAFHENEQRFLGKYLYEIARRHPYFYAPELLYYAEEYKGVFTECCEAADKAACLTPKVDALREKVLASSAKERLKCASLQKFGERAFKAWSVARLSQKFPKAEFAEISKLVTDLAKIHKECCHGDLLECADDRADLAKYICENQDSISTKLKECCGKPVLEKSHCISEVERDELPADLPPLAVDFVEDKEVCKNYQEAKDVFLGTFLYEYSRRHPEYSVSLLLRLAKEYEATLEKCCATDDPPACYAHVFDEFKPLVEEPHNLVKTNCELFEKLGEYGFQNALLVRYTKKVPQVSTPTLVEVSRSLGKVGSKCCTHPEAERLSCAEDYLSVVLNRLCVLHEKTPVSERVTKCCTESLVNRRPCFSALQVDETYVPKEFSAETFTFHADLCTLPEAEKQIKKQSALVELLKHKPKATEEQLKTVMGDFGSFVDKCCAAEDKEACFAEEGPKLVAAAQAALA

SEQ ID NO: 179-181 - skipped (3 entries)

SEQ ID NO: 182 - protein, 171 aa, ARTIFICIAL SEQUENCE
  Synthetic
HEEENVVRSNIDISKISGEWYSILLASDVKEKIEENGSMRVFVEHIKALDNSSLSFVFHTKENGKCTEIFLVADKTKDGVYTVVYDGYNVFSIVETVYDEYILLHLLNFDKTRPFQLVEFYAREPDVSQKLKEKFVKYCQEHGIVNILDLTEVDRCLQARGSEVAQDSSVE

SEQ ID NO: 183-185 - skipped (3 entries)

SEQ ID NO: 186 - protein, 284 aa, ARTIFICIAL SEQUENCE
  Synthetic
MDAIKKKMQAMKLEKDNAMDRADTLEQQNKEANNRAEKSEEEVHNLQKRMQQLENDLDQVQESLLKANIQLVEKDKALSNAEGEVAALNRRIQLLEEDLERSEERLNTATTKLAEASQAADESERMRKVLENRSLSDEERMDALENQLKEARFLAEEADRKYDEVARKLAMVEADLERAEERAETGESKIVELEEELRVVGNNLKSLEVSEEKANQREEAYKEQIKTLTNKLKAAEARAEFAERSVQKLQKEVDRLEDELVNEKEKYKSITDELDQTFSELSGY

SEQ ID NO: 187-189 - skipped (3 entries)

SEQ ID NO: 190 - protein, 247 aa, ARTIFICIAL SEQUENCE
  Synthetic
ADAGYTPAAAATPATPAATPAAAGGKATTDEQKLLEDVNAGFKAAVAAAANAPPADKFKIFEAAFSESSKGLLATSAAKAPGLIPKLDTAYDVAYKAAEATPEAKYDAFVTALTEALRVIAGALEVHAVKPATEEVLAAKIPTGELQIVDKIDAAFKIAATAANAAPTNDKFTVFESAFNKALNECTGGAYETYKFIPSLEAAVKQAYAATVAAAPEVKYAVFEAALTKAITAMTQAQKAGKPAAAA

SEQ ID NO: 191-193 - skipped (3 entries)

SEQ ID NO: 194 - protein, 240 aa, ARTIFICIAL SEQUENCE
  Synthetic
IPKVPPGPNITATYGDKWLDAKSTWYGKPTGAGPKDNGGACGYKDVDKPPFSGMTGCGNTPIFKSGRGCGSCFEIKCTKPEACSGEPVVVHITDDNEEPIAPYHFDLSGHAFGAMAKKGDEQKLRSAGELELQFRRVKCKYPEGTKVTFHVEKGSNPNYLALLVKYVNGDGDVVAVDIKEKGKDKWIELKESWGAIWRIDTPDKLTGPFTVRYTTEGGTKTEAEDVIPEGWKADTSYESK

SEQ ID NO: 195-197 - skipped (3 entries)

SEQ ID NO: 198 - protein, 264 aa, ARTIFICIAL SEQUENCE
  Synthetic
AADLGYGPATPAAPAAGYTPATPAAPAEAAPAGKATTEEQKLIEKINAGFKAALAAAAGVQPADKYRTFVATFGAASNKAFAEGLSGEPKGAAESSSKAALTSKLDAAYKLAYKTAEGATPEAKYDAYVATLSEALRIIAGTLEVHAVKPAAEEVKVIPAGELQVIEKVDAAFKVAATAANAAPANDKFTVFEAAFNDAIKASTGGAYESYKFIPALEAAVKQAYAATVATAPEVKYTVFETALKKAITAMSEAQKAAKPAAAA

SEQ ID NO: 199-200 - skipped (2 entries)

SEQ ID NO: 201 - protein, 536 aa, ARTIFICIAL SEQUENCE
  Synthetic
SIKRDHNDYSKNPMRIVCYVGTWSVYHKVDPYTIEDIDPFKCTHLMYGFAKIDEYKYTIQVFDPYQDDNHNSWEKRGYERFNNLRLKNPELTTMISLGGWYEGSEKYSDMAANPTYRQQFIQSVLDFLQEYKFDGLDLDWEYPGSRLGNPKIDKQNYLALVRELKDAFEPHGYLLTAAVSPGKDKIDRAYDIKELNKLFDWMNVMTYDYHGGWENFYGHNAPLYKRPDETDELHTYFNVNYTMHYYLNNGATRDKLVMGVPFYGRAWSIEDRSKLKLGDPAKGMSPPGFISGEEGVLSYIELCQLFQKEEWHIQYDEYYNAPYGYNDKIWVGYDDLASISCKLAFLKELGVSGVMVWSLENDDFKGHCGPKNPLLNKVHNMINGDEKNSFECILGPSTTTPTPTTTPTTPTTTPTTPSPTTPTTTPSPTTPTTTPSPTTPTTTPSPTTPTPTTPTPAPTTSTPSPTTTEHTSETPKYTTYVDGHLIKCYKEGDIPHPTNIHKYLVCEFVNGGWWVHIMPCPPGTIWCQEKLTCIGE

SEQ ID NO: 202 - protein, 424 aa, ARTIFICIAL SEQUENCE
  Synthetic
SNIRPNVATLEPKTVCYYESWVHWRQGEGKMDPEDIDTSLCTHIVYSYFGIDAATHEIKLLDEYLMKDLHDMEHFTQHKGNAKAMIAVGGSTMSDQFSKTAAVEHYRETFVVSTVDLMTRYGFDGVMIDWSGMQAKDSDNFIKLLDKFDENYNIPAISNYVDFMNVLSLDYTGSWAHTVGHASPFPEQLKTLEAYHKRGAPRHKMVMAVPFYARTWILEKMNKQDIGDKASGPGPRGQFTQTDGFLSYNELCVQIQAETNAFTITRDHDNTAIYAVYVHSNHAEWISFEDRHTLGEKAKNITQQGYAGMSVYTLSNEDVHGVCGDKNPLLHAIQSNYYHGVVTEPTVVTLPPVTHTTEHVTDIPGVFHCHEEGFFRDKTYCATYYECKKGDFGLEKTVHHCANHLQAFDEVSRTCIDHTKIPGC

SEQ ID NO: 203 - protein, 478 aa, ARTIFICIAL SEQUENCE
  Synthetic
NPRFKRDNRDDVLKQTEELIKSAQDVLEKLPDSDLKDEIAEKLATMKHYKHELENAKNPIKIAHFELELLTMFKKFQSLLNEANEIIKSLTTTTTEPTTPTPEPTTTTPEPTTKTPEPTTKTPEPTTPTPEPTTKTPEPTTKTPEPTTPTPEPTTKTPEPTTPTPEPTTKTPEPTTKTPEPSTPTPEPTTKTPEPTTKTPEPSTPTPEPTTKTPEPSTPTPEPTTKTPEPTTKTPEPSTPTPEPTTKTPEPSTPTPEPTTKTPEPSTTKKPNRDDVLKQAEELIKRAEDVFEKLPDSDLKNEIAEKLATMKNYKHELENAKNPIKIAHLESELLTMFKMFQSLLNEADEIIRSLTTTTEPTTLNSTTPEPTTLNSTTPEPTTLNSTTPEPTTLNSTTPEPTTLNSTTPEPTTLNSTTPEPTTLNSTTPEPTTLNSTTPEPTTSNSTTSEPTNSINRKTSEISFLSDWFHKIRTRFNIF

SEQ ID NO: 204 - protein, 158 aa, ARTIFICIAL SEQUENCE
  Synthetic
EDIWKVNKKCTSGGKNQDRKLDQIIQKGQQVKIQNICKLIRDKPHTNQEKEKCMKFCKKVCKGYRGACDGNICYCSRPSNLGPDWKVSKECKDPNNKDSRPTEIVPYRQQLAIPNICKLKNSETNEDSKCKKHCKEKCRGGNDAGCDGNFCYCRPKNK

SEQ ID NO: 205 - protein, 965 aa, ARTIFICIAL SEQUENCE
  Synthetic
SIKRDHNDYSKNPMRIVCYVGTWSVYHKVDPYTIEDIDPFKCTHLMYGFAKIDEYKYTIQVFDPYQDDNHNSWEKRGYERFNNLRLKNPELTTMISLGGWYEGSEKYSDMAANPTYRQQFIQSVLDFLQEYKFDGLDLDWEYPGSRLGNPKIDKQNYLALVRELKDAFEPHGYLLTAAVSPGKDKIDRAYDIKELNKLFDWMNVMTYDYHGGWENFYGHNAPLYKRPDETDELHTYFNVNYTMHYYLNNGATRDKLVMGVPFYGRAWSIEDRSKLKLGDPAKGMSPPGFISGEEGVLSYIELCQLFQKEEWHIQYDEYYNAPYGYNDKIWVGYDDLASISCKLAFLKELGVSGVMVWSLENDDFKGHCGPKNPLLNKVHNMINGDEKNSFECILGPSTTTPTPTTTPTTPTTTPTTPSPTTPTTTPSPTTPTTTPSPTTPTTTPSPTTPTPTTPTPAPTTSTPSPTTTEHTSETPKYTTYVDGHLIKCYKEGDIPHPTNIHKYLVCEFVNGGWWVHIMPCPPGTIWCQEKLTCIGEGPGPGSNIRPNVATLEPKTVCYYESWVHWRQGEGKMDPEDIDTSLCTHIVYSYFGIDAATHEIKLLDEYLMKDLHDMEHFTQHKGNAKAMIAVGGSTMSDQFSKTAAVEHYRETFVVSTVDLMTRYGFDGVMIDWSGMQAKDSDNFIKLLDKFDENYNIPAISNYVDFMNVLSLDYTGSWAHTVGHASPFPEQLKTLEAYHKRGAPRHKMVMAVPFYARTWILEKMNKQDIGDKASGPGPRGQFTQTDGFLSYNELCVQIQAETNAFTITRDHDNTAIYAVYVHSNHAEWISFEDRHTLGEKAKNITQQGYAGMSVYTLSNEDVHGVCGDKNPLLHAIQSNYYHGVVTEPTVVTLPPVTHTTEHVTDIPGVFHCHEEGFFRDKTYCATYYECKKGDFGLEKTVHHCANHLQAFDEVSRTCIDHTKIPGC

SEQ ID NO: 206 - protein, 965 aa, ARTIFICIAL SEQUENCE; identical to SEQ ID NO: 205
  Synthetic

SEQ ID NO: 207 - protein, 134 aa, ARTIFICIAL SEQUENCE
  Synthetic
IIYPGTLWCGHGNKSSGPNELGRFKHTDACCRTHDMCPDVMSAGESKHGLTNTASHTRLSCDCDDKFYDCLKNSADTISSYFVGKMYFNLIDTKCYKLEHPVTGCGERTEGRCLHYTVDKSKPKVYQWFDLRKY

SEQ ID NO: 208 - protein, 349 aa, ARTIFICIAL SEQUENCE
  Synthetic
PDNNKTVREFNVYWNVPTFMCHKYGLRFEEVSEKYGILQNWMDKFRGEEIAILYDPGMFPALLKDPNGNVVARNGGVPQLGNLTKHLQVFRDHLINQIPDKSFPGVGVIDFESWRPIFRQNWASLQPYKKLSVEVVRREHPFWDDQRVEQEAKRRFEKYGQLFMEETLKAAKRMRPAANWGYYAYPYCYNLTPNQPSAQCEATTMQENDKMSWLFESEDVLLPSVYLRWNLTSGERVGLVGGRVKEALRIARQMTTSRKKVLPYYWYKYQDRRDTDLSRADLEATLRKITDLGADGFIIWGSSDDINTKAKCLQFREYLNNELGPAVKRIALNNNANDRLTVDVSVDQV

SEQ ID NO: 209 - protein, 373 aa, ARTIFICIAL SEQUENCE
  Synthetic
ELKQINVIFRHGDRIPDEKNEMYPKDPYLYYDFYPLERGELTNSGKMREYQLGQFLRERYGDFLGDIYTEESVSALSSFYDRTKMSLQLVLAALYPPNKLQQWNEDLNWQPIATKYLRRYEDNIFLPEDCLLFTIELDRVLESPRGKYEFSKYDKLKKKLEEWTGKNITTPWDYYYIYHTLVAEQSYGLTLPSWTNNIFPRGELFDATVFTYNITNSTPLLKKLYGGPLLRIFTKHMLDVVSGTQKKKRKIYLFSGHESNIASVLHALQLYYPHVPEYSSSIIMELHNIEGTHYVKIVYYLGIPSEARELQLPGCEVLCPLYKYLQLIENVIPSNEELICDKRFVDESANNLSIEELDFVKLNLIRIAGTENK

SEQ ID NO: 210 - protein, 752 aa, ARTIFICIAL SEQUENCE
  Synthetic
KSVPRVIDQDLERYEPLEEEDHRGARVPFNLEETYDQSFRANSFNGTWKTDREILYSDNYVGDIRLFDVTTGSGTVLLDSSVTADFDKASVMFSFDNSHVAIGHDYVNGFRYSIHQKCTVYNIKSRTFTDIANGDRIPLFKWSPTRNALIYVHKNDIYYQVFFEGGSDTRRITNTGVPDIVFNGIPDWVYEEEVLGSPVAFWISPDGRHLAFATFNDTNVRDIVISKYGSPGNSRDQYPNEIRIKYPKAGTTNPFVSLSVIDLHDPSSKLIDLPPPVDVVGADNVLYTANWRRDGEIVATWTNRVQNKAQLVLYDTKGNANNIYYEEETEGWLRIQPPLYHDRYVIVAKLQDSGTKAGRFLHATRLEYRNGALVDETDLTPGTCEVISLLLVDHARARLYYLGTELGKPSHKNLYSVQLSGNEPPVCLSCDVLTPEGNRCTYAYAYFSTNGSHYALYCAGPDPVFIAIVNANHRQISIWEENRSLRRKLAARTQPIVKNFNVNANGYTNKVKLYLPPDFDETKKYPLLITVYAGPNTIRITEEATYGFESYIVTNRSVIYGRIDGRGSAYKGSKMLFEIYRRLGTVEIEDQIIITRTLQEKYSWIDSNRTGIWGWSYGGFSAAMVLATDAESVFKCGISVAPVTSWIYYDSLYTERFMGLPTPEDNQSGYNDTDVSRRVEGMRGKKYMLIHGTADDNVHYQQTMMLNKALVNSDIMFQQQTYTDEAHALGNVFPHLYHTTDRFWANCLGYSH

SEQ ID NO: 211 - protein, 204 aa, ARTIFICIAL SEQUENCE
  Synthetic
FPGAHDEDSKEERKNVDTVLVLPSIERDQMMAATFDFPSLSFEDSDEGSNWNWNTLLRPNFLDGWYQTLQSAISAHMKKVREQMAGILSRIPEQGVVNWNKIPEGANTTSTTKIIDGHVVTINETTYTDGSDDYSTLIRVRVIDVRPQNETILTTVSSEADSDVTTLPTLIGKNETSTQSSRSVESVEDFDNEIPKNQGDVLTA

SEQ ID NO: 212 - protein, 300 aa, ARTIFICIAL SEQUENCE
  Synthetic
GPKCPFNSDTVSIIIETRENRNRDLYTLQTLQNHPEFKKKTITRPVVFITHGFTSSASETNFINLAKALVDKDNYMVISIDWQTAACTNEAAGLKYLYYPTAARNTRLVGQYIATITQKLVKHYKISMANIRLIGHSLGAHASGFAGKKVQELKLGKYSEIIGLDPARPSFDSNHCSERLCETDAEYVQIIHTSNYLGTEKTLGTVDFYMNNGKNQPGCGRFFSEVCSHSRAVIYMAECIKHECCLIGIPKSKSSQPISSCTKQECVCVGLNAKKYPSRGSFYVPVESTAPFCNNKGKII

SEQ ID NO: 213 - protein, 331 aa, ARTIFICIAL SEQUENCE
  Synthetic
SERPKRVFNIYWNVPTFMCHQYDLYFDEVTNFNIKRNSKDDFQGDKIAIFYDPGEFPALLSLKDGKYKKRNGGVPQEGNITIHLQKFIENLDKIYPNRNFSGIGVIDFERWRPIFRQNWGNMKIHKNFSIDLVRNEHPTWNKKMIELEASKRFEKYARFFMEETLKLAKKTRKQADWGYYGYPYCFNMSPNNLVPECDVTAMHENDKMSWLFNNQNVLLPSVYVRQELTPDQRIGLVQGRVKEAVRISNNLKHSPKVLSYWWYVYQDETNTFLTETDVKKTFQEIVINGGDGIIIWGSSSDVNSLSKCKRLQDYLLTVLGPIAINVTEAVN

SEQ ID NO: 214 - protein, 751 aa, ARTIFICIAL SEQUENCE
  Synthetic
RVIDKDNSDRIVKTQNDQNLSKVPFNLEETYTADFLAYVFNGTWTSDTTIVYTDRRTGDILQFDVIKQRSTLIVDSSVMDAYIVSNYVLSPKGRYLLIGYDLKKGYRYSTFMRYVIYDIEHRAYHKIGNDMHIALAKWAPLTDDLIYILDNDIYYMRFSNNGFNDVQRVTYDGISGIVYNGVPDWVYEEEVLQDSSAIWFSPDGNHLAYASFDDRNVQEILYLHYGEPGNLDDQYPTEVKIKYPKVGTLNPVVSLTLVDLHDPTLNKIDLKAPHYAVGTDNLLYNVQWKDFDHVVVTWSNRVQNKTEIVWYNMYGEIVKTLHVVEHKGWLDIKHLFFYKGSVYIRKLQPSGTKAGRFHHVTRYDETFKQSPTQMDLTPDAIEVQNICTIDQSNGRIYYLASGLGKPSQKNLYSVPADGSEKPTCISCNVLTPEGNVCTYADAIFSPLGQYYVLVCHGPDPAFVSIFNNAHQKVYSWENNLSLRKKLAKRHLPLVKDLDVRANGYESKVRLFLPHNFDESKSYPMLVNVYAGPNTLKIIDAASYGHQVYMTTNRSVIYAYIDGRGSSNKGSKMLFSIYRKLGTVEVEDQITVTRQLQEMFPWIDSKRTGVWGWSYGGFSTAMILAKDTSFVFKCGIAIAPVSSWIYYDSIYTERFMGFPTPEDNLSGYNETDVSRRVEDIRGKKFMLIHGSGDDNVHYQQSLALAKALEKADVMFEQITYTDEAHALFGVLPHLYHTMDRFWSDCFSLSHAH

SEQ ID NO: 215 - protein, 204 aa, ARTIFICIAL SEQUENCE
  Synthetic
NNYCKIKCLKGGVHTACKYGSLKPNCGNKVVVSYGLTKQEKQDILKEHNDFRQKIARGLETRGNPGPQPPAKNMKNLVWNDELAYVAQVWANQCQYGHDTCRDVAKYQVGQNVALTGSTAAKYDDPVKLVKMWEDEVKDYNPKKKFSGNDFLKTGHYTQMVWANTKEVGCGSIKYIQEKWHKHYLVCNYGPSGNFMNEELYQTK

SEQ ID NO: 216 - protein, 302 aa, ARTIFICIAL SEQUENCE
  Synthetic
GITPDCTFNEKDIELHVYSRDKRNGIILKKEILKNYDLFQKSQISHQIAILIHGFLSTGNNENFDAMAKALIEIDNFLVISVDWKKGACNAFASTNDVLGYSQAVGNTRHVGKYVADFTKLLVEQYKVPMSNIRLIGHSLGAHTSGFAGKEVQRLKLGKYKEIIGLDPAGPSFLTNKCPNRLCETDAEYVQAIHTSAILGVYYNVGSVDFYVNYGKSQPGCSEPSCSHTKAVKYLTECIKRECCLIGTPWKSYFSTPKPISQCKRDTCVCVGLNAQSYPAKGSFYVPVDKDAPYCHNEGIKL

SEQ ID NO: 217 - protein, 206 aa, ARTIFICIAL SEQUENCE
  Synthetic
NDYCKIKCSSGVHTVCQYGESTKPSKNCAGKLIKSVGPTEEEKKLIVEEHNRFRQKVAKGLETRGNPGPQPAASNMNNLVWNDELAKIAQVWASQCQILVHDKCRNTEKYQVGQNIAYAGSSNHFPSVTKLIQLWENEVKDFNYNTGITNKNFGKVGHYTQMVWGNTKEVGCGSLKYVEKNMQIHYLICNYGPAGNYLGQPIYTKK

SEQ ID NO: 218 - protein, 626 aa, ARTIFICIAL SEQUENCE
  Synthetic
MRGRVSPLMLLLGILVLASVSATHAKSSPYQKKTENPCAQRCLQSCQQEPDDLKQKACESRCTKLEYDPRCVYDPRGHTGTTNQRSPPGERTRGRQPGDYDDDRRQPRREEGGRWGPAGPREREREEDWRQPREDWRRPSHQQPRKIRPEGREGEQEWGTPGSHVREETSRNNPFYFPSRRFSTRYGNQNGRIRVLQRFDQRSRQFQNLQNHRIVQIEAKPNTLVLPKHADADNILVIQQGQATVTVANGNNRKSFNLDEGHALRIPSGFISYILNRHDNQNLRVAKISMPVNTPGQFEDFFPASSRDQSSYLQGFSRNTLEAAFNAEFNEIRRVLLEENAGGEQEERGQRRWSTRSSENNEGVIVKVSKEHVEELTKHAKSVSKKGSEEEGDITNPINLREGEPDLSNNFGKLFEVKPDKKNPQLQDLDMMLTCVEIKEGALMLPHFNSKAMVIVVVNKGTGNLELVAVRKEQQQRGRREEEEDEDEEEEGSNREVRRYTARLKEGDVFIMPAAHPVAINASSELHLLGFGINAENNHRIFLAGDKDNVIDQIEKQAKDLAFPGSGEQVEKLIKNQKESHFVSARPQSQSQSPSSPEKESPEKEDQEEENQGGKGPLLSILKAFN

SEQ ID NO: 219 - protein, 169 aa, ARTIFICIAL SEQUENCE
  Synthetic
LTILVAPALFLLAAHASARQQWELQGDRRCQSQLERANLRPCEQHLMQKIQRDEDSYGRDPYSPSQDPYSPSQDPDRRDPYSPSPYDRRGAGSSQHQERCCNELNEFENNQRCMCEALQQIMENQSDRLQGRQQEQQFKRELRNLPQQCGLRAPQRCDLEVESGGRDRY

SEQ ID NO: 220 - protein, 512 aa, ARTIFICIAL SEQUENCE
  Synthetic
MAKLLALSLCFCVLVLGASSVTFRQGGEENECQFQRLNAQRPDNRIESEGGYIETWNPNNQEFQCAGVALSRTVLRRNALRRPFYSNAPLEIYVQQGSGYFGLIFPGCPSTYEEPAQEGRRYQSQKPSRRFQVGQDDPSQQQQDSHQKVHRFDEGDLIAVPTGVAFWMYNDEDTDVVTVTLSDTSSIHNQLDQFPRRFYLAGNQEQEFLRYQQQQGSRPHYRQISPRVRGDEQENEGSNIFSGFAQEFLQHAFQVDRQTVENLRGENEREEQGAIVTVKGGLRILSPDEEDESSRSPPNRREEFDEDRSRPQQRGKYDENRRGYKNGIEETICSASVKKNLGRSSNPDIYNPQAGSLRSVNELDLPILGWLGLSAQHGTIYRNAMFVPHYTLNAHTIVVALNGRAHVQVVDSNGNRVYDEELQEGHVLVVPQNFAVAAKAQSENYEYLAFKTDSRPSIANQAGENSIIDNLPEEVVANSYRLPREQARQLKNNNPFKFFVPPFDHQSMREVA

SEQ ID NO: 221 - protein, 1270 aa, ARTIFICIAL SEQUENCE
  Synthetic
KSSPYQKKTENPCAQRCLQSCQQEPDDLKQKACESRCTKLEYDPRCVYDPRGHTGTTNQRSPPGERTRGRQPGDYDDDRRQPRREEGGRWGPAGPREREREEDWRQPREDWRRPSHQQPRKIRPEGREGEQEWGTPGSHVREETSRNNPFYFPSRRFSTRYGNQNGRIRVLQRFDQRSRQFQNLQNHRIVQIEAKPNTLVLPKHADADNILVIQQGQATVTVANGNNRKSFNLDEGHALRIPSGFISYILNRHDNQNLRVAKISMPVNTPGQFEDFFPASSRDQSSYLQGFSRNTLEAAFNAEFNEIRRVLLEENAGGEQEERGQRRWSTRSSENNEGVIVKVSKEHVEELTKHAKSVSKKGSEEEGDITNPINLREGEPDLSNNFGKLFEVKPDKKNPQLQDLDMMLTCVEIKEGALMLPHFNSKAMVIVVVNKGTGNLELVAVRKEQQQRGRREEEEDEDEEEEGSNREVRRYTARLKEGDVFIMPAAHPVAINASSELHLLGFGINAENNHRIFLAGDKDNVIDQIEKQAKDLAFPGSGEQVEKLIKNQKESHFVSARPQSQSQSPSSPEKESPEKEDQEEENQGGKGPLLSILKAFNGGGGLTILVAPALFLLAAHASARQQWELQGDRRCQSQLERANLRPCEQHLMQKIQRDEDSYGRDPYSPSQDPYSPSQDPDRRDPYSPSPYDRRGAGSSQHQERCCNELNEFENNQRCMCEALQQIMENQSDRLQGRQQEQQFKRELRNLPQQCGLRAPQRCDLEVESGGRDRYGGGGVTFRQGGEENECQFQRLNAQRPDNRIESEGGYIETWNPNNQEFQCAGVALSRTVLRRNALRRPFYSNAPLEIYVQQGSGYFGLIFPGCPSTYEEPAQEGRRYQSQKPSRRFQVGQDDPSQQQQDSHQKVHRFDEGDLIAVPTGVAFWMYNDEDTDVVTVTLSDTSSIHNQLDQFPRRFYLAGNQEQEFLRYQQQQGSRPHYRQISPRVRGDEQENEGSNIFSGFAQEFLQHAFQVDRQTVENLRGENEREEQGAIVTVKGGLRILSPDEEDESSRSPPNRREEFDEDRSRPQQRGKYDENRRGYKNGIEETICSASVKKNLGRSSNPDIYNPQAGSLRSVNELDLPILGWLGLSAQHGTIYRNAMFVPHYTLNAHTIVVALNGRAHVQVVDSNGNRVYDEELQEGHVLVVPQNFAVAAKAQSENYEYLAFKTDSRPSIANQAGENSIIDNLPEEVVANSYRLPREQARQLKNNNPFKFFVPPFDHQSMREVA

SEQ ID NO: 222 - protein, 374 aa, ARTIFICIAL SEQUENCE
  Synthetic
MDSPCLVALLVFSFVIGSCFSDNPIDSCWRGDSNWAQNRMKLADCAVGFGSSTMGGKGGDLYTVTNSDDDPVNPAPGTLRYGATRDRPLWIIFSGNMNIKLKMPMYIAGYKTFDGRGAQVYIGNGGPCVFIKRVSNVIIHGLYLYGCSTSVLGNVLINESFGVEPVHPQDGDALTLRTATNIWIDHNSFSNSSDGLVDVTLTSTGVTISNNLFFNHHKVMSLGHDDAYSDDKSMKVTVAFNQFGPNCGQRMPRARYGLVHVANNNYDPWTIYAIGGSSNPTILSEGNSFTAPNESYKKQVTIRIGCKTSSSCSNWVWQSTQDVFYNGAYFVSSGKYEGGNIYTKKEAFNVENGNATPHLTQNAGVLTCSLSKRC

SEQ ID NO: 223 - protein, 514 aa, ARTIFICIAL SEQUENCE
  Synthetic
MAMKLIAPMAFLAMQLIIMAAVEDQSAQIMLDSVVEKYLRSNRSLRKVEHSRHDAINIFNVEKYGAVGDGKHDCTEAFSTAWQAACKNPSAMLLVPGSKKFVVNNLFFNGPCQPHFTFKVDGIIAAYQNPASWKNNRIWLQFAKLTGFTLMGKGVIDGQGKQWWAGQCKWVNGREICNDRDRPTAIKFDFSTGLIIQGLKLMNSPEFHLVFGNCEGVKIIGISITAPRDSPNTDGIDIFASKNFHLQKNTIGTGDDCVAIGTGSSNIVIEDLICGPGHGISIGSLGRENSRAEVSYVHVNGAKFIDTQNGLRIKTWQGGSGMASHIIYENVEMINSENPILINQFYCTSASACQNQRSAVQIQDVTYKNIRGTSATAAAIQLKCSDSMPCKDIKLSDISLKLTSGKIASCLNDNANGYFSGHVIPACKNLSPSAKRKESKSHKHPKTVMVENMRAYDKGNRTRILLGSRPPNCTNKCHGCSPCKAKLVIVHRIMPQEYYPQRWICSCHGKIYHP

SEQ ID NO: 224 - protein, 852 aa, ARTIFICIAL SEQUENCE
  Synthetic
EDNPIDSCWRGDSNWAQNRMKLADCAVGFGSSTMGGKGGDLYTVTNSDDDPVNPAPGTLRYGATRDRPLWIIFSGNMNIKLKMPMYIAGYKTFDGRGAQVYIGNGGPCVFIKRVSNVIIHGLHLYGCSTSVLGNVLINESFGVEPVHPQDGDALTLRTATNIWIDHNSFSNSSDGLVDVTLSSTGVTISNNLFFNHHKVMLLGHDDAYSDDKSMKVTVAFNQFGPNCGQRMPRARYGLVHVANNNYDPWTIYAIGGSSNPTILSEGNSFTAPNESYKKQVTIRIGCKTSSSCSNWVWQSTQDVFYNGAYFVSSGKYEGGNIYTKKEAFNVENGNATPQLTKNAGVLTCSLSKRCGPGPGLEDQSAQIMLDSVVEKYLRSNRSLRKVEHSRHDAINIFNVEKYGAVGDGKHDCTEAFSTAWQAACKNPSAMLLVPGSKKFVVNNLFFNGPCQPHFTFKVDGIIAAYQNPASWKNNRIWLQFAKLTGFTLMGKGVIDGQGKQWWAGQCKWVNGREICNDRDRPTAIKFDFSTGLIIQGLKLMNSPEFHLVFGNCEGVKIIGISITAPRDSPNTDGIDIFASKNFHLQKNTIGTGDDCVAIGTGSSNIVIEDLICGPGHGISIGSLGRENSRAEVSYVHVNGAKFIDTQNGLRIKTWQGGSGMASHIIYENVEMINSENPILINQFYCTSASACQNQRSAVQIQDVTYKNIRGTSATAAAIQLKCSDSMPCKDIKLSDISLKLTSGKIASCLNDNANGYFSGHVIPACKNLSPSAKRKESKSHKHPKTVMVENMRAYDKGNRTRILLGSRPPNCTNKCHGCSPCKAKLVIVHRIMPQEYYPQRWICSCHGKIYHP

SEQ ID NO: 225 - protein, 225 aa, ARTIFICIAL SEQUENCE
  Synthetic
MAKVSDLALLLVAGMAISLYIQETGAVKFDIKNQCGYTVWAAGLPGGGQQLTQGQTWTVNLAAGTQSARFWGRTGCSFDASGKGTCQTGDCGGQLSCTVSGAVPATLAEYTQSDQDYYDVSLVDGFNIPLSINPTNAQCTAPACKADVNAVCPAELKVDGGCKSACAAFQTDQYCCTGTYANSCPATNYSMIFKNQCPQAYSYPKDDTATFACPSGTDYSIVFCP

SEQ ID NO: 226 - protein, 281 aa, ARTIFICIAL SEQUENCE
  Synthetic
MGIMATQNSKSNIFWSSSASVVLVLLLLVDVGVCQNCGCNGLCCSQYGYCGSGEAYCGAGCKEGPCSSSSPPSTGTGVGSIVSSDVFNSIVGGAASGCAGNGFYTYDSFISAANAFNGFGTSGSSDVNKREIAAFFANAAHETGGFCYIEEQNPTSIYCDASNTQYPCASGKTYHGRGPLQLSWNYNYGAAGSYIQFDGLNNPEIVGTDSTISFKTAVWFWMVNSNCHTAITSGQGFGATIRAINSMECDGGNAATVASRVNYYQKFCQQLNVDTGSALQC

SEQ ID NO: 227 - protein, 306 aa, ARTIFICIAL SEQUENCE
  Synthetic
MGGSRVLIIGGTGYIGRHVTNASLAQGHPTFLLVREITPSNPEKAQLLESFTSKGATLVQGSIDDHASLVAALKKVDVVISTLGAPQIADQFNLIKAIKEVGTIKRFFPSEFGNDVDKHHAVEPMKSMFDLKIKLRRTIEAEGIPHTYVVPHCFAGYFLTNLAQLGLAAPPRDKIVIYGDGTTKAVYMKEEDIGTFTIKAVDDPRTLNKTLYLKPPANTISTNDLVALWEAKIGKTLEKVYLSEEQVLKLLQDTPFPGTFMVSIFHTIYVKGDQTNFQIGPDGVEASALYPDVKYTTVEEYISAFV

SEQ ID NO: 228 - protein, 165 aa, ARTIFICIAL SEQUENCE
  Synthetic
MAMRMKSSSMSSYRFSYCQMMLVLMVMTLVQIGAAQSDTNSCVNSLVPCASYLNATTKPPDSCCVPLLNVIQTQQQCLCNLLNSSIVKQSSINITQALNIPRLCGDTNVSTDACSTNATANAPSASTTPSVPADTGDSSGIGATSLQIFLPLLAVFFLGVFKSFP

SEQ ID NO: 229 - protein, 472 aa, ARTIFICIAL SEQUENCE
  Synthetic
MARRLCSFLLSFLIIVSVWAENSKFARLNLASFTWKDAEDNKNCSAGELETSSLSVMHIQGKCSPFRLLNSSWWTAVSESIKGDTARYRAMVKGGWSAGKTMVNPQEDADIPLASGQAESSSNYIIKLGFGTPPQSFYTVLDTGSNIAWIPCNPCSGCSSKQQPFEPSKSSTYNYLTCASQQCQLLRVCTKSDNSVNCSLTQRYGDQSEVDEILSSETLSVGSQQVENFVFGCSNAARGLIQRTPSLVGFGRNPLSFVSQTATLYDSTFSYCLPSLFSSAFTGSLLLGKEALSAQGLKFTPLLSNSRYPSFYYVGLNGISVGEELVSIPAGTLSLDESTGRGTIIDSGTVITRLVEPAYNAMRDSFRSQLSNLTMASPTDLFDTCTNRPSGDVEFPLITLHFDDNLDLTLPLDNILYPGNDDGSVLCLAFGLPPGGGDDVLSTFGNYQQQKLRIVHDVAESRLGIASGNCDG

SEQ ID NO: 230 - protein, 348 aa, ARTIFICIAL SEQUENCE
  Synthetic
MELLKQHRYMFLLISCIVILLNSMHADCEQIGVNYGMDGNNLPSAGDVVSLMKKNNIGKMRIFGPNADVLRAFANSRIEVIVGVENKGLEAVASSQDSANGWVNDNIKPFYPSTNIKYIAVGNEVLEMPDNAQYVSFLVPAIKNIQTALENANLQNNIKVSTAHAMTVIGTSSPPSKGTFKDAVKDSMSSILQFLQDHGSPFMANVYPYFSYDGDRSIKLDYALFNPTPPVVDEGLSYTNLFDAMVDAVLSAMESLGHPNIPIVITESGWPSAGKSVATIENAQTYNNNLIKHVLSNAGTPKRPGSSIETYIFALFNENLKGPAEVEKHFGLFNPDEQPVYPVKFSLN

SEQ ID NO: 231 - protein, 375 aa, ARTIFICIAL SEQUENCE
  Synthetic
MASCTLLAVLVFLCAIVSCFSDNPIDSCWRGDANWDQNRMKLADCAVGFGSSAMGGKGGAFYTVTSSDDDPVNPAPGTLRYGATRERSLWIIFSKNLNIKLNMPLYIAGNKTIDGRGAEVHIGNGGPCLFMRTVSHVILHGLNIHGCNTSVSGNVLISEASGVVPVHAQDGDAITMRNVTDVWIDHNSLSDSSDGLVDVTLASTGVTISNNHFFNHHKVMLLGHSDIYSDDKSMKVTVAFNQFGPNAGQRMPRARYGLIHVANNNYDPWSIYAIGGSSNPTILSEGNSFTAPNDSDKKEVTRRVGCESPSTCANWVWRSTQDSFNNGAYFVSSGKNEGTNIYNNNEAFKVENGSAAPQLTKNAGVLTCILSKPCS

SEQ ID NO: 232 - protein, 367 aa, ARTIFICIAL SEQUENCE
  Synthetic
MASPCLIAVLVFLCAIVSCYSDNPIDSCWRGDSNWDQNRMKLADCAVGFGSSTMGGKGGDFYTVTSTDDNPVNPTPGTLRYGATREKALWIIFSQNMNIKLKMPLYVAGHKTIDGRGADVHLGNGGPCLFMRKVSHVILHSLHIHGCNTSVLGDVLVSESIGVEPVHAQDGDAITMRNVTNAWIDHNSLSDCSDGLIDVTLGSTGITISNNHFFNHHKVMLLGHDDTYDDDKSMKVTVAFNQFGPNAGQRMPRARYGLVHVANNNYDPWNIYAIGGSSNPTILSEGNSFTAPSESYKKEVTKRIGCESPSACANWVWRSTRDAFINGAYFVSSGKTEETNIYNSNEAFKVENGNAAPQLTKNAGVVT

SEQ ID NO: 233 - protein, 367 aa, ARTIFICIAL SEQUENCE
  Synthetic
MASPCLIAFLVFLCAIVSCCSDNPIDSCWRGDSNWGQNRMKLADCAVGFGSSTMGGKGGDFYTVTSADDNPVNPTPGTLRYGATREKTLWIIFSQNMNIKLKMPLYVAGHKTIDGRGADVHLGNGGPCLFMRKVSHVILHGLHIHGCNTSVLGDVLVSESIGVVPVHAQDGDAITMRNVTNAWIDHNSLSDCSDGLIDVTLGSTGITIFNNHFFNHHKVMLLGHDDTYDDDKSMKVTVAFNQFGPNAGQRMPRARYGLVHVANNNYDPWNIYAIGGSSNPTILSEGNSFTAPNENYKYEVTKRIGCESTSACANWVWRSTRDAFSNGAYFVSSGKIEETNIYNSNEAFKVENGNAAPQLTKNAGVVA

SEQ ID NO: 234 - protein, 367 aa, ARTIFICIAL SEQUENCE
  Synthetic
MASPCLVAVLVFLCAIVSCYSDNPIDSCWRGDSNWDQNRMKLADCVVGFGSLTMGGKGGEIYTVTSSDDNPVNPTPGTLRYGATREKALWIIFSQNMNIKLQMPLYVAGYKTIDGRGADVHLGNGGPCLFMRTASHVILHGLHIHGCNTSVLGDVLVSESIGVEPVHAQDGDAITMRNVTNAWIDHNSLSDCSDGLIDVTLGSTGITISNNHFFNHHKVMLLGHDDTYDDDISMKVTVAFNQFGPNAGQRMPRARYGLVHVANNNYDQWNIYAIGGSSNPTILSEGNSPTAPSESYKKEVTKRIGCESTSACANWVWRFTRDAFTNGAYFVSSGKAEETNIYNSNEAFKVENGNAAPQLTQNAGVVT

SEQ ID NO: 235 - protein, 366 aa, ARTIFICIAL SEQUENCE
  Synthetic
MASPCLRAVLVFLCAIVSCYSDNPIDSCWRGDSNWGQNRMKLADCVVGFGSSTMGGKGGEFYTVTSAEDNPVNPTPGTLRYGATREKALWIIFSQNMNIKLKMPLYVAGHKTIDGRGADVHLGNGGPCLFMRKVSHVILHGLHIGCNTSVLGDVLVSESIGVEPVHAQDGDAITMRNVTNAWIDHNSLSDCSDGLIDVTLGSTGITISNNHFFNHHKVMLLGHDDTYDNDKSMKVTVAFNQFGPNAGQRMPRARYGLVHVANNNYDPWNIYAIGGSSNPTILSEGNSFTAPSESYKKEVTKRIGCESTSACANWVWRSTRDAFTNGAYFVSSGKIEETNIYNSNEAFKVENGNAAPQLTKNAGVVT

SEQ ID NO: 236 - protein, 367 aa, ARTIFICIAL SEQUENCE
  Synthetic
MDSPCLIAVLVFLCAIVSCYSDNPIDSCWRGDSNWDQNRMKLADCAVGFGSSTMGGKGGDIYTVTSAEDNPVNPTPGTLRYGATREKALWIIFSQNMNIKLKMPLYVAGHKTIDGRGADVHLGNGGPCLFMRKVSHVILHGLHIHGCNTSVLGNVLVSESIGVEPVHAQDGDAITMRNVTNAWIDHNSLSDCSDGLIDVTLSSTGITISNNHFFNHHKVMLLGHDDTYDDDKSMKVTVAFNQFGPNAGQRMPRARYGLVHVANNNYDQWNIYAIGGSSNPTILSEGNSFAAPNENYKKEVTKRIGCVSTSACANWVWRSTRDAFSNGAYFVSSGKTEETNIYTSNEAFKVENGNLAPQLTKNAGVVA

SEQ ID NO: 237 - protein, 514 aa, ARTIFICIAL SEQUENCE
  Synthetic
MGMKFMAAVAFLALQLIVMAAAEDQSAQIMLDSDIEEYLRSNRSLKKLVHSRHDAATVFNVEQYGAVGDGKHDSTEAFATTWNAACKKASAVLLVPANKKFFVNNLVFRGPCQPHLSFKVDGTIVAQPDPARWKNSKIWLQFAQLTDFNLMGTFVIDGQGQQWWAGQCKVVNGRTVCNDRNRPTAIKIDYSKSVTVKELTLMNSPEFHLVFGECEGVKIQGLKIKAPRDSPNTDGIDIFASKRFHIEKCVIGTGDDCIAIGTGSSNITIKDLICGPGHGISIGSLGRDNSRAEVSHVHVNRAKFIDTQNGLRIKTWQGGSGLASYITYENVEMINSENPILINQFYCTSASACQNQRSAVQIQGVTYKNIHGTSATAAAIQLMCSDSVPCTGIQLSNVSLKLTSGKPASCVDKNARGFYSGRLIPTCKNLRPGPSPKEFELQQQPTTVMDENKGACAKGDSTCISLSSSPPNCKNKCKGCQPCKPKLIIVHPNKPQDYYPQKWVCSCHNKIYNP

SEQ ID NO: 238 - protein, 507 aa, ARTIFICIAL SEQUENCE
  Synthetic
MSMKFMAALAFLALQLIVMAAGEDQSAQIMLDSDTKQYHRSSRNLRKAVHHARHDVAIVFNVEHYGAVGDGKHDSTDAFEKTWNAACNKLSAVFLVPANKKFVVNNLVFYGPCQPHFSFKVDGTIAAYPDPAKWLNSKIWMHFARLTDFNLMGTGVIDGQGNRWWSDQCKTINGRTVCNDKGRPTAIKIDFSKSVTVKELTLTNSPEFHLVFGECDGVKIQGIKIKAPRDSPNTDGIDIFASKRFEIEKCTIGTGDDCVAVGTGSSNITIKDLTCGPGHGMSIGSLGKGNSRSEVSFVHLDGAKFIDTQNGLRIKTWQGGSGLASHITYENVEMINAENPILINQFYCTSAAACKNQRSAVKIQDVTFKNIHGTSATTAAIQLMCSDSVPCSNIKLSNVFLKLTSGKVATCVNKNANGYYTNPLNPSCKSLHPGRTPKELELHQKPTTLLMDEKMGASLNSSPPNCKNKCKGCQPCKPKLIIVHPNQPEDYYPQRWVCSCHNKIYNP

SEQ ID NO: 239 - protein, 384 aa, ARTIFICIAL SEQUENCE
  Synthetic
HDVAIVFNVEHHGAVGDGNHDSTDAFEKTWNEACKTLSAVFLVPANKKFVVVNNLVFYGPCQPHFSPKVDGIIAAYPDPVKWKNSKIWMHFARLTDFNLMGTGVIDGQGSKWWSDQCKTVNGRTVCNDKGRPTAIKIDFSKSVTVKELTLMNSPEFHLVFGECDGVKIQGIKIKAPKESPNTDGIDIFGSKRFEIEKCIIGTGDDCVAIGTGSSNITITDLTCGPGHGMSIGSLGKGNSRSEVSFVHLDGAKFIDTQNGLRIKTWQGGSGLASHITYENVEMVNAENPILINQFYCTSAACENQRSAVKIEDVWFKNIHGTSATAAAIQLMCSDSVPCSNIKLSNVVLKLSSGKVAACVNKNANGYYTNPLNPPCKSLHPGPTP

SEQ ID NO: 240 - protein, 225 aa, ARTIFICIAL SEQUENCE
  Synthetic
MARVSELAFLLAATLAISLHMQEAGVVKFDIKNQCGYTVWAAGLPGGGKRLDQGQTWTVNLAAGTASARFWGRTGCTFDASGKGSCQTGDCGGQLSCTVSGAVPATLAEYTQSDQDYYDVSLVDGFNIPLAINPTNAQCTAPACKADINAVCPSELKVDGGCNSACNVFKTDQYCCRNAYVDNCPATNYSKIFKNQCPQAYSYAKDDTATFACASGTDYSIVFCP

SEQ ID NO: 241 - protein, 225 aa, ARTIFICIAL SEQUENCE
  Synthetic
MARVSELALLLVATLAISLHMQEAGAVKFDIKNQCGYTVWAAGLPGGGKRLDQGQTWTLNLAAGTASARFWGRTGCTFDASGKGSCKTGDCGGQLSCTVSGAVPATLAEYTQSDQDYYDVSLVDGFNIPLAINPTNAQCTAPACKADINAVCPSELKVEGGCNSACNVFQTDQYCCRNAYVDNCPATNYSKIFKNQCPQAYSYAKDDTATFACASGTDYSIVFCP

SEQ ID NO: 242 - protein, 224 aa, ARTIFICIAL SEQUENCE
  Synthetic
MARVSELALLLVATLAISLHMQEAGAVKFDIKNQCGYTVWAAGLPGGGKRLDQGQTWTVNLAAGTASARFWGRTGCTFDASGKGSCRSGDCGGQLSCTVSGAVPATLAEYTQSDKDYYDVSLVDGFNIPLAINPTNTKCTAPACKADINAVCPSELKVDGGCNSACNVLQTDQYCCRNAYVDNCPATNYSKIFKNQCPQAYSYAKDDTATFACASGTDYSIVFC

SEQ ID NO: 243 - protein, 199 aa, ARTIFICIAL SEQUENCE
  Synthetic
VKFDIKNQCGYTVWAAGLPGGGKEFDQGQTWTVNLAAGTASARFWGRTGCTFDASGKGSCRSGDCGGQLSCTVSGAVPATLAEYTQSDQDYYDVSLVDGFNIPLAINPTNTKCTAPACKADINAVCPSELKVDGGCNSACNVLQTDQYCCRNAYVNNCPATNYSKIFKNQCPQAYSYAKDDTATFACASGTDYSIVFCP

SEQ ID NO: 244 - protein, 274 aa, ARTIFICIAL SEQUENCE
  Synthetic
MGNSSGNSLMVLLLVLLLVGVTVNAQNCGCASGLCCSQYGYCGSSSAYCGAGCKSGPCSGGGSPSGGGGSVGTIISQSFFNGLAGGAASSCEGKGFYTYNAFIAAANAYSGFGTTGSADVTKRELAAFLANVMHGTGGMCYINERTPPMIYCMSSATWPCASGKSYHGRGPLQLSWNYNYGAAGQSIGFDGVNNPEKVGQDSTISFKTAVWFWMKNSNCHSAITSGQGFGGTIKAINSQECNGGNSGEVNSRVNYYKNICSQLGVDPGANLSCH

SEQ ID NO: 245 - protein, 277 aa, ARTIFICIAL SEQUENCE
  Synthetic
MGKTGGEKWVMALVLVLLLLGVSVNAQNCGCASGLCCSKYGYCGTTSAYCGTGCRSGPCSSNSGGGSPSGGGGSVGTIISQSIFNGLAGGAASSCEGKGFYTYTAFIKAASAYSGFGTTGSNDVKKRELAAFFANVMHETGGLCYINERNPPMIYCNSSSTWPCASGKSYHGRGPLQLSWNYNYGAAGKSIGFDGLNNPEKVGQDATISFKTAVWFWMNNSNCHSAITGGQGFGATIKAINSGECNGGNSGEVSSRVNYYRKICSQLGVDPGANVSC

SEQ ID NO: 246 - protein, 308 aa, ARTIFICIAL SEQUENCE
  Synthetic
MGSRSRILLIGATGYIGRHVAKASLDLGHPTFLLVRESTASSNSEKAQLLESFKASGANIVHGSIDDHASLVEAVKNVDVVISTVGSLQIESQVNIIKAIKEVGTVKRFFPSEFGNDVDNVHAVEPAKSVFEVKAKVRRAIEAEGIPYTYVSSNCFAGYFLRSLAQAGLTAPPRDKVVILGDGNARVVFVKEEDIGTFTIKAVDDPRTLNKTLYLRLPANTLSLNELVALWEKKIDKTLEKAYVPEEEVLKLIADTPFPANISIAISHSIFVKGDQTNFEIGPAGVEASQLYPDVKYTTVDEYLSNFV

SEQ ID NO: 247 - protein, 173 aa, ARTIFICIAL SEQUENCE
  Synthetic
MDSRRLKRSGIVCMVLMSMLMLVVCEDSDNTACLSSLSSCAPYLNATTKPDSSCCSALISVIDKDSQCLCNLLNSDTVKQLGVNVTQAMKMPAECGKNVSATQCNKTATSGGSSVGKTPTSTPPPSSATPSTTTITKSNSNAAASVSVKMFPVAALVFVAVASVLGLKGPCLR

SEQ ID NO: 248 - protein, 124 aa, ARTIFICIAL SEQUENCE
  Synthetic
MRRERGRQGDSSSCERQVDRVNLKPCEQHIMQRIMGEQEQYDSYDIRSTRSSDQQQRCCDELNEMENTQRCMCEALQQIMENQCDRLQDRQMVQQFKRELMNLPQQCNFRAPQRCDLDVSGGRC

SEQ ID NO: 249 - protein, 157 aa, ARTIFICIAL SEQUENCE
  Synthetic
MGVFTFEDEITSTVPPAKLYNAMKDADSITPKIIDDVKSVEIVEGNGGPGTIKKLTIVEDGETKFILHKVESIDEANYAYNYSVVGGVALPPTAEKITFETKLVEGPNGGSIGKLTLKYHTKGDAKPDEEELKKGKAKGEGLFRAIEGYVLANPTQY

SEQ ID NO: 250 - protein, 92 aa, ARTIFICIAL SEQUENCE
  Synthetic
ISCGQVNSALAPCIPFLTKGGAPPPACCSGVRGLLGALRTTADRQAACNCLKAAAGSLRGLNQGNAAALPGRCGVSIPYKISTSTNCATIKF

SEQ ID NO: 251 - protein, 5 aa, Artificial Sequence
  linker
GPGPG

SEQ ID NO: 252 - protein, 5 aa, Artificial Sequence
  linker
PMGLP

What is claimed:

1. A polynucleotide encoding a lysosomal associated membrane protein (LAMP) Construct, wherein the LAMP Construct comprises:

1) two homology domains of a luminal domain of a LAMP protein, and 2) at least one allergen comprising CryJ1 and/or CryJ2, wherein the allergen is placed between the two homology domains.

2. The polynucleotide of claim 1, wherein the LAMP protein is selected from LAMP-1, LAMP2, LAMP-3, LIMP 2, Macrosialin, Endolyn, LAMP5 or LIMBIC.

3. The polynucleotide of claim 2, wherein the LAMP Protein comprises an amino acid sequence selected from any one of SEQ ID NO:1-113.

4. The polynucleotide of claim 2, wherein the LAMP Protein comprises an amino acid sequence at least about 70%, at least about 75%, at least about 80%, at least about 85%, at least about 90%, at least about 95%, 96%, 97%, 98% or 99% identical to the amino acid sequence of any one of SEQ ID NO:1-113.

5. The polynucleotide of claim 1, wherein each allergen is separated by a linker.

6. The polynucleotide of claim 5, wherein the linker is selected from the amino acid sequence GPGPG (SEQ ID NO: 251) or PMGLP (SEQ ID NO: 252).

7. The polynucleotide of claim 1, wherein the LAMP Construct further comprises a Transmembrane Domain and/or a Cytoplasmic Tail of a LAMP Protein.

8. The polynucleotide of claim 1, wherein the LAMP Construct further comprises a signal sequence.

9. The polynucleotide of claim 8, wherein the signal sequence is derived from a LAMP Protein.

10. A host cell comprising the polynucleotide of claim 1 or comprising a vector comprising the polynucleotide.

11. A vector comprising the polynucleotide of claim 1.

12. The polynucleotide of claim 1, wherein the LAMP Protein is human LAMP-1.

13. The polynucleotide of claim 12, wherein the two homology domains comprise human LAMP-1 Homology Domain 1 and human LAMP-1 Homology Domain 2.

14. The polynucleotide of claim 13, wherein the human LAMP-1 Homology Domain 1 comprises:

(a) the amino acid sequence of residues 29 to 194 of SEQ ID NO: 1, or (b) a variant of (a) wherein said variant comprises an amino acid sequence at least 95% or at least 97% identical to the amino acid sequence of (a); and/or wherein the human LAMP-1 Homology Domain 2 comprises the amino acid sequence of residues 228 to 381 or residues 228 to 382 of SEQ ID NO: 1.

15. The polynucleotide of claim 7, wherein the Transmembrane Domain comprises residues 383-405 of SEQ ID NO: 1 and/or wherein the Cytoplasmic Tail comprises residues 406 to 417 of SEQ ID NO: 1.

16. The polynucleotide of claim 1, wherein the allergen comprises:

(a) the amino acid sequence of residues 22-374 of SEQ ID NO: 222, residues 23-514 of SEQ ID NO: 223, and/or SEQ ID NO: 224; or (b) an amino acid sequence that is at least 95% identical to the amino acid sequence of residues 22-374 of SEQ ID NO: 222, residues 23-514 of SEQ ID NO: 223, or SEQ ID NO: 224.

17. The polynucleotide of claim 1, wherein the polynucleotide is DNA.

18. The polynucleotide of claim 1, wherein the polynucleotide is RNA.

19. The polynucleotide of claim 1, wherein the polynucleotide is a viral vector.

20. The polynucleotide of claim 4, wherein the polynucleotide is a self-replicating RNA viral vector.

21. An antigen presenting cell comprising the polynucleotide of claim 1.

22. The antigen presenting cell of claim 21, wherein the cell is a dendritic cell.

23. A pharmaceutical composition comprising (a) the polynucleotide of claim 1, (b) a vector comprising the polynucleotide, or (c) an antigen presenting cell comprising the polynucleotide.

24. The polynucleotide of claim 1, wherein the allergen comprises an amino acid sequence comprising residues 22-374 of SEQ ID NO: 222 or an amino acid sequence at least 95% identical to residues 22-374 of SEQ ID NO: 222, and comprising residues 23-514 of SEQ ID NO: 223 or an amino acid sequence at least 95% identical to the amino acid sequence of residues 23-514 of SEQ ID NO: 223.

25. The polynucleotide of claim 1, wherein the allergen comprises the amino acid sequence of SEQ ID NO: 224 or an amino acid sequence at least 95% identical to the amino acid sequence of SEQ ID NO: 224.

* * * * *

UNITED STATES PATENT AND TRADEMARK OFFICE
CERTIFICATE OF CORRECTION

PATENT NO. : 12,398,195 B2
APPLICATION NO. : 17/053784
DATED : August 26, 2025
INVENTOR(S) : Teri Heiland Page 1 of 1

It is certified that error appears in the above-identified patent and that said Letters Patent is hereby corrected as shown below:

In the Claims

Column 72, Line 38, Claim 20 should read:
The polynucleotide of claim 1, wherein the polynucleotide is a self-replicating RNA viral vector.

Signed and Sealed this
Fourteenth Day of October, 2025

John A. Squires
*Director of the United States Patent and Trademark Office*